United States Patent 7,745,391 (HUMAN THROMBOSPONDIN POLYPEPTIDE) - sequence listing, part 92

SEQ ID NO: 300398 - DNA, 1816 bp, Homo sapiens
acgtaggtaacctggttttgaatggcgaggggcttgccccggtgagccccgcgtaccgctccgagcccgccgcacatcctctgagcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaattcaaaaaaaaaaaaggggggg

SEQ ID NO: 300399 - DNA, 1883 bp, Homo sapiens
agcggaaaaggaccccggcttccttgcgccctggacggcgggggccaggcccctggggagctgagagggaggcgctgagggaggagcgggcgaggggccccggcagcccggccgcggggagggatcgcgagcggccggcgcgggcctggctgcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaattcaaaaaaaaaaaaggggggg

SEQ ID NO: 300400 - DNA, 1653 bp, Homo sapiens
  misc_feature (1)..(1): n is a, c, g, or t
  misc_feature (3)..(3): n is a, c, g, or t
  misc_feature (6)..(6): n is a, c, g, or t
  misc_feature (16)..(16): n is a, c, g, or t
  misc_feature (25)..(25): n is a, c, g, or t
ngnctnggtagcgagnctgggtggngcaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaattcaaaaaaaaaaaaggggggg

SEQ ID NO: 300401 - DNA, 1802 bp, Homo sapiens
  misc_feature (22)..(22): n is a, c, g, or t
  misc_feature (78)..(78): n is a, c, g, or t
  misc_feature (84)..(84): n is a, c, g, or t
  misc_feature (90)..(91): n is a, c, g, or t
  misc_feature (97)..(97): n is a, c, g, or t
  misc_feature (160)..(160): n is a, c, g, or t
agcgggctgtagccagcccccnttccccgagcccgccgccacatcctctgagaagatggctgtgccacccacgtatgnccgaantttccnnttggcnaaatctgccagggatgtcttcaccaagggctatggatttggcttaataacaacacggcccctntggcaatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaattcaaaaaaaaaaaaggggggg

SEQ ID NO: 300402 - DNA, 1507 bp, Homo sapiens
atcccgttataaatggctgttacactaggcccgagattttgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaattcaaaaaaaaaaaaggggggg

SEQ ID NO: 300403 - DNA, 1538 bp, Homo sapiens
atgccaaggcatgggttaaccggagcctctcggggaaaaagtttcccactgagtgccagtaagtcgtcgaccacgcgtcgcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaattcaaaaaaaaaaaaggggggg

SEQ ID NO: 300404 - DNA, 1987 bp, Homo sapiens
  misc_feature (340)..(340): n is a, c, g, or t
  misc_feature (358)..(358): n is a, c, g, or t
  misc_feature (457)..(457): n is a, c, g, or t
cgcgttcgacacgacgctcgccgatattcgactccgtaggcccgacgtgagatttctctgagcagaagatggcttgtagccaagcctcgagctggtagtgcctggattcctgtgagacataactcatggccacgagggaatgctccttccaacccgaagggcgccttcatcgagattgtctcgcgctatgacataagaaagcgtgtcgattgtggaaagacaccaatgaatcttcgtacatagtgtgattcggaaagtttaacaagaagcatcgcaggcctccacgaccaaccatcttgcagggacccatccgacatagtcgtatccgggaccacgtctngtggatagatccgacacngtgacaaggactcgtgcaacttggaggtcacttgcgcacttgtacccgtctttactatggagtacatatcgcgacgataaacccgaatctcaataatcnactacaaaggccatccagcatgtatcttacgtgggttgcgtaaacggatgcgaggcttttgcgacagtagagacgtgcacagcttgacctttcggattccattcgctttctcaaccttaacaacttgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaattcaaaaaaaaaaaaggggggg

SEQ ID NO: 300405 - DNA, 1193 bp, Homo sapiens
acgctgtcccgggcggggcctgggggcggagcgcgccgggccgggcgcgcaggaggggaggcgggtccgcgccgccgccgtccgcgccgccccgcccttggcccagccgctcgctcggctccgctccctggctcggctccctgcctccgcgtcgcagcccccgccgtagccgcctccgagcccgccgccacatcctctgagcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggcgagcacggggat

SEQ ID NO: 300406 - DNA, 1461 bp, Homo sapiens
gccggaagggggaaatagccgtggtacgagatatcaaattcaaaaacggaaatgtaatcatggcaagttaaatcagtggtggattttagagccatggcttccaggccagagctaatctggtggacctcatgaaggcactgtctgaatactttccatggtacgatagtttggtctccaaaaaactttctccagaagtcagcagcatcggctttggtgatacgaaagttatctccctggaatcgaccatggggaaagatggcttagatttctgccagcatgtgactgaagaatgacgggacagagtttggcggctccatttaccagaaagtgaacaagaagttggagaccgctgtcaatcttgcctggacagcaggaaacagtaacacgcgcttcggaatagcagccaagtatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaattcaaaaaaaaaaaaggggggg

SEQ ID NO: 300407 - DNA, 1079 bp, Homo sapiens
cgctcgcgaacgtgttatcctaaacctatcagattgaccctgacgcctgcttctcggctaaagtgaacaactccagcctgataggtttaggatacactcagactctaaagccaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaattcaaaaaaaaaaaaggggggg

SEQ ID NO: 300408 - DNA, 1296 bp, Homo sapiens
acgctgtcccgggcggggcctgggggcggagcgcgccgggccgggcgcgcaggaggggaggcgggtccgcgccgccgccgtccgcgccgccccgcccttggcccagccgctcgctcggctccgctccctggctcggctccctgcctccgcgtcgcagcccccgccgtagccgcctccgagcccgccgccacatcctctgagcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacagggtacaagcgggagcacattaacctgggctgcgacatggatttcgacattgctgggccttccatccggggtgctctggtgctaggttacgagggctggctggccggctaccagatgaattttgagactgcaaaatcccgagtgacccagagcaactttgcagttggctacaagactgatgaattccagcttcacactaatgtgtggacggtgtatggattgatgaccgatttcatgggaaaaaaaaggaagtagcttgccaaaagtctctggactctgtgaccgtgcctgattgaccaaaaatttcttcagcagctgctctacaaatatgcaatggaccctttaagcatttctcctttacagtgagcacaatgctaagctttgtcagcagatgccactggagcagcattgcagaagaaagcgagtttctcttcctgattttggtgtgctacttttcttcttcttgctccagctgcattatccatcagtggtactatgtataagaccatcccgctgtgccctgccctaccacctgcccagaggcacattcctcactgactatttggcctgattctgagcctgtggccaccttctcacagccctgcaacacaggcactgtgtgctccaaggctcacgtccccagcagtggcctgactgtgcacttagccacagccttagtttgcctgtgcttcaagaaattgcatcctattttgccagcagctatgggccaactcctggccc

SEQ ID NO: 300409 - DNA, 1582 bp, Homo sapiens
gtgtccatttttttttatctctgctctttcgtttgcttccggttatctctcgtggtccgcgtcttcctcttcctgcagttgtctctgtcctggtttggcccctttttttggtcctatatcagtggtatggtgtagcacattggggtgtcactcccctatgagcttgtgttcccttacccctattccatgagtgtgagtatcaaccgaggccattagattctgagcgtcgtcaccaggtgttctatcccacgacacttcccagctatactggagctcctggaagctattttcatactctgggcaagggcatattaatacactacacaagaagggaataagtcctgaattattggcttcatcacatccaccttctccacccctaaatggcacaaagaaacagttaccacaccctgcagaccttttggtgtaaaagagatgatgatgaactggggtgggaacaggtcatgaagatctgtctaaaaaagtcccattcaggtgagtttgtacacaccatcaagcagcgagcctctcatcaattagggttagggaaccaaggttcgattctcaggaaatcacaatttcattcatttactcaatattgaatttacaagtgcctacatattatccgcttccacttgcagccatttctagataaaaaagaaacctggcatctcaaagggccaccaagttctccccgagtctaccactgaaaggaccttttttggaaataggtttcttctgtacctctggaagggtaacatcttaaagctagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttggtggcccctttgagatgccaggtttcttttttatctagaaatggctgcaagtggaagcggataatatgtaggcactttgtaaattcatattgagtaaatgaatgaaattgtgatttcctgagaatcgaaccttggttccctaaccctaattgatgagaggctcgctgcttgatggtgtgtacaaactcacctgaatgggacttttttagacagatcttcatgacctgttcccaccccagttcatcatcatctcttttacaccaaaaggtctgcagggtgtggtaactgtttcttttgtgccattttggggtggagaaggtggatgtgatgaagccaataattcaggacttattccttcttgtgttgtgtttttttttggcccttgcaccagagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaattcaaaaaaaaaaaaggggggg

SEQ ID NO: 300410 - DNA, 1289 bp, Homo sapiens
gcttttcccaatccacgttttgttttattttgtctttttgcctctcaaatgcatggaaattggctgctagtagctttgctacaggagaaaatcgctaatctgtagtgcaaaatcggcgcacaggggttttctctgagattgtctagacgccgcgcgggcgggtcggaggcgccagacacattgtatccggagcgcggagctcgggagcaacagtcgccgcctctactctgtatctgcgccgccccaggcgcccagtgtccgcgctgggcctgggactgccctcgggggatggggcccacgcgggctttgatggggggccgggggccactttgtccacccaggcgaggcttgggtccagcgccggccacatcaactcccgggggatctagcagcgcggaggccaagcaggaggcccaggagccccgcgcgtcttccattagcgcagggacctccgggccacagctcagagaatcggaaggcctcctcccccttcccgagcgctgccactggggccgaggtttccagcaagaacccgcgtgtccctgcgcacgcacacacggtgcacacgtcagtccggcgcctccccgtgccccgactcacgcaggtcctcccgcgcgcccgcaacacgcccgcaggctcctgtgtctgctgccggggcagcggggcccggaaggcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactgggaaaaaaaatgctaaaatcaagacaggagtatgaaatagcttccaggagctccagctataagcttggaagtgtctgtgtgattgtaatcacatggtgacaacactcagaatctaaattggacttctgttgtattctcaccactcaatttgttttttagcagtttaatgggtacattttagagtcttccattttgttggaattagatcctccccttcaaatgctgtaattaacaacacttaaaaaacttgaataaaatattgaaattcaaaaaaaaaaaaggggggg

SEQ ID NO: 300411 - DNA, 1027 bp, Homo sapiens
  misc_feature (1021)..(1021): n is a, c, g, or t
gcttttcccaatccacgttttgttttattttgtctttttgcctctcaaatgcatggaaattggctgctagtagctttgctacaggagaaaatcgctaatctgtagtgcaaaatcggcgcacaggggttttctctgagattgtctagacgccgcgcgggcgggtcggaggcgccagacacattgtatccggagcgcggagctcgggagcaacagtcgccgcctctactctgtatctgcgccgccccaggcgcccagtgtccgcgctgggcctgggactgccctcgggggatggggcccacgcgggctttgatggggggccgggggccactttgtccacccaggcgaggcttgggtccagcgccggccacatcaactcccgggggatctagcagcgcggaggccaagcaggaggcccaggagccccgcgcgtcttccattagcgcagggacctccgggccacagctcagagaatcggaaggcctcctcccccttcccgagcgctgccactggggccgaggtttccagcaagaacccgcgtgtccctgcgcacgcacacacggtgcacacgtcagtccggcgcctccccgtgccccgactcacgcaggtcctcccgcgcgcccgcaacacgcccgcaggctcctgtgtctgctgccggggcagcggggcccggaaggcagaagatggctgtgccacccacgtatgccgatcttggcaaatctgccagggatgtcttcaccaagggctatggatttggcttaataaagcttgatttgaaaacaaaatctgagaatggattggaatttacaagctcaggctcagccaacactgagaccaccaaagtgacgggcagtctggaaaccaagtacagatggactgagtacggcctgacgtttacagagaaatggaataccgacaatacactaggcaccgagattactgtggaagatcagcttgcacgtggactgaagctgaccttcgattcatccttctcacctaacactggtccccatcacgaatgcanagccat

SEQ ID NO: 300412 - DNA, 894 bp, Homo sapiens
ggaaaagtggtttgcaggtttcctctgcacagttggctaggccagtccacggcgtattatagttctagtgtataaccacttttgaaccctggaaatctaagactaccagctactccctgaatcaggttattccagggaatgtcagtttgttgtgtgcatctgtggatgtacatgcacactacacatgtgtgtacactatgaacatgaacatgtaagaccttaggttggattcaggattgaggtttcatttaaagggatgattgccaaagaagcttactgcatgctaccagtgctatagactaattgtaccaggggaacagtgagaggaaaaaggaaagtggggttccagaagtagatttgggtaggctctctgggcggtgggataattatagttgttttataagcccactgtagtatgcctgttggtcagatagtgctaagtaacaaggattgaagggccatgtagtttggaccctgctgataatacctggaacaggttctgaatttggtgttaatctttcttgtcatttctttcctccattcctcctcctttcctctccctcatttttctccctgcaggtattaaactgacactgtcagctcttctggatggcaagaacgtcaatgctggtggccacaagcttggtctaggactggaatttcaagcataaatgaatactgtacaattgtttaattttaaactattttgcagcatagctaccttcagaatttagtgtatcttttaatgttgtatgtctgggatgcaagtattgctaaatatgttagccctccaggttaaagttgattcagctttaagatgttacccttccagaggtacagaagaaacctatttccaaaaaaggtcctttcagtggtagactcggggagaacttg

SEQ ID NO: 300413 - DNA, 2310 bp, Homo sapiens
ccccgtttccatctctttccctggggtgtccccagccagacctgcgcgtcctgtccctcacatttgatcactgtgaccttctgggggaggggggagttgaaaatgcacatcggcctcagatatttttttcttttttctcctatttggtgttaacatacacccaagcccacccggcccgtcgtgacctctgatctgtgcccactcctccggttccagacgcacctctctcctctgtcttcacagtggggtgtggggcccgtgggatgggcctcaggccaccaggcaataaccacagggcctgcagcagtgcccctgccagccccgaatcccacccccgggaccagccacatccacagcacaactgccccgctggagaggcaccatgggcgtggaggggcttcccggacaccgcccacccgggacccgcctcttccaccaagacagagacgttagcaacgcatggcgggtggggacctggggtgctcaggagggggtacccggggccccggccagagatacatcaattacacccccgtggggggacagccgatgggagccagcaccagcaggatccgagggcgccccggacagaggtctgccccacccacttcctccccaccacctgtgccccagagagcagggcctgcccgggaaggtggcgtcctggagtcgagtgtacctgcagccatgaggttctgggtgttttttgagagagtctgagtgacaccacactcgtgtgaccccacagggttgtgtccaacatacacggaagtggctatggaatggtgtatttgtgcaacctggggtgcgcggatgggtgacttgtatctaagtgcatctgcgtgtatacctgtgtgtgtctgtctgggatgatatgtttttgtggcagtctgtgtgtgtaatagtggtgtagggtatacagagaggtgggtagttgtagatacctgtgtgtggttgtcagcaagactggatatgtgtgaggtgtctgtgtgaatctttgtgcctgtatgagcatgactatattttggggagtgggtgatatggtttatctgagagcatttatctgtaaatatgtttgtcctgattgagggacacgatctgtgttccactctatagcaacatgactctagcaatgtgactttcggttccaaatctgtatcagtcagctactgctgtgtaacaaatgaccacaaatgtagcaaccagaaacaacacatgcttattatctcatagattctgtgggtcaagagcctgggtgcaggttggctgggtcctctacttgggatctcaggaggctgcaatcaaagcattcgccaggcagaggtctcatctgaaggcctgatcggggaaggatttgcttcttagaagctcatgtggttgttgcagcattcagttccttgctgttgcaagactgaaggcctcagttcctcgctggctgttggctggaagctgccctttgttctgtaccatgtgggtctctccacagcggggctcggagcatggcagctaagttagtgagggaaggtgagatggaggttttggtcttattgggtgtgaggaagcaacgtgtgtgtgtgcgcacgcccttttgtgcagtgagagagagagagagattgcacacatgtgtctctgtagtcatgtggccaggtgggactatgtaggtaacagattgctcgtgtctgatttggtacaagcatgtttgttttcctctgtgttcgtgtgagtgtttactcaacaaatgtttattggacacactcagagagagggagtgtgcacacgtgcgtgtgtgttgctatccagcacgtggaccgggctcccagaagagctggcattgtgtctgagcagagctgggtccccccaaaacttgggctggcccagggcccaccagcagctgatgttgcctcctctcctgtcctggcagtagcttctgggttctgaaggtgccggagagagtgaggctgggcaggggtctgcggccctttctcagggacacaccctgatagcacaatctccttggggccctgcccacctccaggcctctcccacctcaggccctgcccgaccctggggagagagggcatctgcaataggagggggcccgagcctgtcctggctgctggcccatcctgcctgggcatccctggtgctggggactgtgccaggccatgcttgctgtgactccgcccctgccccctctccccccgcatgtgggtgcccccactcccccatcgtggggtctgtgtagccttcgctctagacatagtcttcctgcaataaaaaagtggatcctgcattccccaccaaaaaagc

SEQ ID NO: 300414 - DNA, 2741 bp, Homo sapiens
cgcgcgcaagctccccgggcccagtaggctgggggtgggggtagaaggagaaggaggggaagggaggggggggttgggtgtctactctggtgaatagacggctgtggggcagagaagcgtgaaggcctggctgccgggcaggtgaactctccacggggtctagggcccgcgaaagggttcggaaccgagtcagcgcgccttgcgggcaggattcacgccgctgtgacccggaggtcctcagggggcgaagccccggcctaggcctcgcggagatgcccagctgcggtgcttgtacttgcggcgcggcggccgtccggctcatcacctcctcactcgcctccgcgcagagaggtatttctggtggtcgcattcatatgtcagttttaggaaggcttgggacatttgaaactcagattctgcaaagagctcctcttagatcctttacagaaacaccagcatactttgcctcaaaagatgggataagtaaagatggttctggagatggaaataagaaatcagcaagtgagggaagtagtaagaaatcaggctctgggaattctgggaaaggtggaaaccagctgcgctgtcctaaatgtggcgacttgtgcacacatgtagagacctttgtatcatccacccgttttgtcaagtgtgaaaagtgtcatcatttttttgttgtgctatctgaagcagactcaaagaaaagcataattaaagaacctgaatcagcagcagaagctgtaaaattggcattccaacagaaaccaccacctccccctaagaagatttataactacctcgacaagtatgttgttggccagtcatttgctaagaaggtgctttcagttgctgtgtacaatcattataagagaatatataataatatcccagctaatctgagacagcaagcagaggttgagaagcagacatcattaacaccaagagagttagaaataagaagacgggaggatgagtacagatttacaaaattgcttcagattgctggaattagcccacatggtaatgctttaggagcatcaatgcagcaacaggtaaatcaacaaatacctcaggaaaaacgaggaggtgaagtattggattcttctcatgatgacataaaacttgaaaaaagtaatattttgctgcttggaccaactgggtcaggtaaaactctgctggcacaaaccctagctaaatgccttgatgtcccttttgctatctgtgactgtacaactttgactcaggctggatatgtaggcgaagatattgaatctgtgattgcaaaactactccaagatgccaattataatgtggaaaaagcacaacaaggaattgtctttctggatgaagtagataagattggcagtgtgccaggcattcatcaattacgggatgtaggtggagaaggcgttcagcaaggcttattaaaactactagaaggcacaatagtcaatgttccagaaaagaattcccgaaagctccgtggagaaacagttcaagttgatacaacaaacatcctgtttgtggcatctggtgctttcaatggtttagacagaatcatcagcaggaggaaaaatgaaaagtatcttggatttggaacaccatctaatctgggaaaaggcagaagggctgcagctgctgcagaccttgctaatcgaagtggggaatcgaatactcaccaagacattgaagaaaaagatcggttattgcgtcatgtggaagccagagatctgattgagtttggcatgattcctgagtttgtgggacggttgcctgtggtggttccattgcatagcctagatgagaaaacacttgtacaaatattaactgagccacgaaatgctgttattcctcagtaccaggccttattcagcatggataagtgtgaactgaatgttactgaggatgctttgaaagctatagccagattggcactagaacgaaaaacaggtgcacgaggccttcggtccataatggaaaagctgttactagaaccaatgtttgaagtccctaattctgatatcgtatgtgtggaggttgacaaagaagtagtagaaggaaaaaaggaaccaggatacatccgggctccaacaaaagaatcctctgaagaggagtatgactctggagttgaagaagaaggatggccccgccaagcagatgctgcaaacagctaaactgtcatattgctgtcttgtatatacagcttttccttcttttgtttaggatcataattgtctctacagtctgatattaaaggcattggatctatcttggatatcatacatggtcagagaagcctttaggagaagaatcagatcatgtatataattgtaacatcacattgattttacggaagatgttatatggactttaatgacacaatgtttagagataaaatgtacattattttggttcagttttttaaaaaaaatatgctttaacaaaattcttaggaattcttttaagcaatgcaggtattgcgataactgtagattttacaataatgttactctacaaatgggaaaataaattctttaaaattgaatattgagataccattctttagtgttaccttttttacccacatgtgtttctgaaaatattggaattttattcatcttaaaaattggaccaggtaggccgggcgtggtggctcacgcctgtaatcccagcactttgggaggccaaggcgggtggatcacgaggtcaggagttcaagaccagcctggccaagatggtga

SEQ ID NO: 300415 - DNA, 3211 bp, Homo sapiens
cgcgcgcaagctccccgggcccagtaggctgggggtgggggtagaaggagaaggaggggaagggaggggggggttgggtgtctactctggtgaatagacggctgtggggcagagaagcgtgaaggcctggctgccgggcaggtgaactctccacggggtctagggcccgcgaaagggttcggaaccgagtcagcgcgccttgcgggcaggattcacgccgctgtgacccggaggtcctcagggggcgaagccccggcctaggcctcgcggagatgcccagctgcggtgcttgtacttgcggcgcggcggccgtccggctcatcacctcctcactcgcctccgcgcagagaggtatttctggtggtcgcattcatatgtcagttttaggaaggcttgggacatttgaaactcagattctgcaaagagctcctcttagatcctttacagaaacaccagcatactttgcctcaaaagatgggataagtaaagatggttctggagatggaaataagaaatcagcaagtgagggaagtagtaagaaatcaggctctgggaattctgggaaaggtggaaaccagctgcgctgtcctaaatgtggcgacttgtgcacacatgtagagacctttgtatcatccacccgttttgtcaagtgtgaaaagtgtcatcatttttttgttgtgctatctgaagcagactcaaagaaaagcataattaaagaacctgaatcagcagcagaagctgtaaaattggcattccaacagaaaccaccacctccccctaagaagatttataactacctcgacaagtatgttgttggccagtcatttgctaagaaggtgctttcagttgctgtgtacaatcattataagagaatatataataatatcccagctaatctgagacagcaagcagaggttgagaagcagacatcattaacaccaagagagttagaaataagaagacgggaggatgagtacagatttacaaaattgcttcagattgctggaattagcccacatggtaatgctttaggagcatcaatgcagcaacaggtaaatcaacaaatacctcaggaaaaacgaggaggtgaagtattggattcttctcatgatgacataaaacttgaaaaaagtaatattttgctgcttggaccaactgggtcaggtaaaactctgctggcacaaaccctagctaaatgccttgatgtcccttttgctatctgtgactgtacaactttgactcaggctggatatgtaggcgaagatattgaatctgtgattgcaaaactactccaagatgccaattataatgtggaaaaagcacaacaaggaattgtctttctggatgaagtagataagattggcagtgtgccaggcattcatcaattacgggatgtaggtggagaaggcgttcagcaaggcttattaaaactactagaaggcacaatagtcaatgttccagaaaagaattcccgaaagctccgtggagaaacagttcaagttgatacaacaaacatcctgtttgtggcatctggtgctttcaatggtttagacagaatcatcagcaggaggaaaaatgaaaagtatcttggatttggaacaccatctaatctgggaaaaggcagaagggctgcagctgctgcagaccttgctaatcgaagtggggaatcgaatactcaccaagacattgaagaaaaagatcggttattgcgtcatgtggaagccagagatctgattgagtttggcatgattcctgagtttgtgggacggttgcctgtggtggttccattgcatagcctagatgagaaaacacttgtacaaatattaactgaccaccacacccggccttatttaccatctttaatccattttagtactatgggtgagtacatggaattgaagtctggcttaaatcttcagaaagttatatatctattttattttatttttttgagacagagtctcgctgtgtcacccaggctggagtacagtgccacaatcttggctcactgcaacctctgagtcccaggttcaagcgatactcatgcctcagcctcctgagtagctgggactacaggcgtgcaccaccacacctggctaattttttgtatttttagtagagacggggtttcgccatgttgcccaggctggtctctcctgagctcaggcaatcggccaccttggcctctgaaagtgctagaattacgggcatgagccaccgcatccagccagaaagatacatatctaattctagaaatagcatgcagtatcagtcatagtaacagccatgtgctgacctaaataaaatttcttgatattgtgtatttaacctgaagtattgagctagtttttttgttttgttttttggtgctgaacattttggtctaattctttggcttcttagaacattttaaaaaatctatgttttgctatcagccaaagtaaatgtgttcacactaacatataagttactaaccttcattatacagcaaagctaaaaagtggtgggatatttggggtcttaatgaaaattgtatcatttaattccataaatattaaaatatttgggtaccttttaagctttttttctttccttctataatggtggtacaagttctatattcattcagtttaatctcatttgaaattgtttaaatcagagtacatgtaaatatttgtgggtttttttttttggtttatagactcgagctttccttttacacagttttttttagggaaaaactaaagctattaggaaattctaaatcttgttgatgaagagttgggctttctttgatataattaataaaagggatgtatggtatttatggctgggtaggaccagaaatgcactttgtattacagagtgttaaggctggttgctatagtatggaacagaaacacctctccttggtctccctagtaatggttcaagttcttcccaggaagtcttacatattataactttgttcattatctttcccttatagcatcattttcctttttgtagagtggaaatcagactagctgctaaacatattaaggttaatcctccagaaatgtactggggaggcattttagtcacaacaacttacatttggctttggaagttgttaacaaagcatagtcgatgtttttaaatcaaacataatttgtatcttggaacttacattttgacatttgaataaaacaaaaagactaaatgaaaaaaa

SEQ ID NO: 300416 - DNA, 3277 bp, Homo sapiens
cgcgcgcaagctccccgggcccagtaggctgggggtgggggtagaaggagaaggaggggaagggaggggggggttgggtgtctactctggtgaatagacggctgtggggcagagaagcgtgaaggcctggctgccgggcaggtgaactctccacggggtctagggcccgcgaaagggttcggaaccgagtcagcgcgccttgcgggcaggattcacgccgctgtgacccggaggtcctcagggggcgaagccccggcctaggcctcgcggagatgcccagctgcggtgcttgtacttgcggcgcggcggccgtccggctcatcacctcctcactcgcctccgcgcagagaggtatttctggtggtcgcattcatatgtcagttttaggaaggcttgggacatttgaaactcagattctgcaaagagctcctcttagatcctttacagaaacaccagcatactttgcctcaaaagatgggataagtaaagatggttctggagatggaaataagaaatcagcaagtgagggaagtagtaagaaatcaggctctgggaattctgggaaaggtggaaaccagctgcgctgtcctaaatgtggcgacttgtgcacacatgtagagacctttgtatcatccacccgttttgtcaagtgtgaaaagtgtcatcatttttttgttgtgctatctgaagcagactcaaagaaaagcataattaaagaacctgaatcagcagcagaagctgtaaaattggcattccaacagaaaccaccacctccccctaagaagatttataactacctcgacaagtatgttgttggccagtcatttgctaagaaggtgctttcagttgctgtgtacaatcattataagagaatatataataatatcccagctaatctgagacagcaagcagaggttgagaagcagacatcattaacaccaagagagttagaaataagaagacgggaggatgagtacagatttacaaaattgcttcagattgctggaattagcccacatggtaatgctttaggagcatcaatgcagcaacaggtaaatcaacaaatacctcaggaaaaacgaggaggtgaagtattggattcttctcatgatgacataaaacttgaaaaaagtaatattttgctgcttggaccaactgggtcaggtaaaactctgctggcacaaaccctagctaaatgccttgatgtcccttttgctatctgtgactgtacaactttgactcaggctggatatgtaggcgaagatattgaatctgtgattgcaaaactactccaagatgccaattataatgtggaaaaagcacaacaaggaattgtctttctggatgaagtagataagattggcagtgtgccaggcattcatcaattacgggatgtaggtggagaaggcgttcagcaagtaagcagttgaatatttttttcaagcccactaaaaggaagggaatacatcaacctcccaaatattggcttattaaaactactagaaggcacaatagtcaatgttccagaaaagaattcccgaaagctccgtggagaaacagttcaagttgatacaacaaacatcctgtttgtggcatctggtgctttcaatggtttagacagaatcatcagcaggaggaaaaatgaaaagtatcttggatttggaacaccatctaatctgggaaaaggcagaagggctgcagctgctgcagaccttgctaatcgaagtggggaatcgaatactcaccaagacattgaagaaaaagatcggttattgcgtcatgtggaagccagagatctgattgagtttggcatgattcctgagtttgtgggacggttgcctgtggtggttccattgcatagcctagatgagaaaacacttgtacaaatattaactgaccaccacacccggccttatttaccatctttaatccattttagtactatgggtgagtacatggaattgaagtctggcttaaatcttcagaaagttatatatctattttattttatttttttgagacagagtctcgctgtgtcacccaggctggagtacagtgccacaatcttggctcactgcaacctctgagtcccaggttcaagcgatactcatgcctcagcctcctgagtagctgggactacaggcgtgcaccaccacacctggctaattttttgtatttttagtagagacggggtttcgccatgttgcccaggctggtctctcctgagctcaggcaatcggccaccttggcctctgaaagtgctagaattacgggcatgagccaccgcatccagccagaaagatacatatctaattctagaaatagcatgcagtatcagtcatagtaacagccatgtgctgacctaaataaaatttcttgatattgtgtatttaacctgaagtattgagctagtttttttgttttgttttttggtgctgaacattttggtctaattctttggcttcttagaacattttaaaaaatctatgttttgctatcagccaaagtaaatgtgttcacactaacatataagttactaaccttcattatacagcaaagctaaaaagtggtgggatatttggggtcttaatgaaaattgtatcatttaattccataaatattaaaatatttgggtaccttttaagctttttttctttccttctataatggtggtacaagttctatattcattcagtttaatctcatttgaaattgtttaaatcagagtacatgtaaatatttgtgggtttttttttttggtttatagactcgagctttccttttacacagttttttttagggaaaaactaaagctattaggaaattctaaatcttgttgatgaagagttgggctttctttgatataattaataaaagggatgtatggtatttatggctgggtaggaccagaaatgcactttgtattacagagtgttaaggctggttgctatagtatggaacagaaacacctctccttggtctccctagtaatggttcaagttcttcccaggaagtcttacatattataactttgttcattatctttcccttatagcatcattttcctttttgtagagtggaaatcagactagctgctaaacatattaaggttaatcctccagaaatgtactggggaggcattttagtcacaacaacttacatttggctttggaagttgttaacaaagcatagtcgatgtttttaaatcaaacataatttgtatcttggaacttacattttgacatttgaataaaacaaaaagactaaatgaaaaaaa

SEQ ID NO: 300417 - DNA, 1746 bp, Homo sapiens
aatgcatgacactaacttcccaattggttctgtaaaaaaggcccatttttcttaccaagttgtctgatttatttaccatcttttttttttttttttttttaattgagcggagtctcacgctgtcccaagctgaagtgcagtggtgcgatcttggctcactgcaacctccgcctcccaggttcaagcaattttcctgcctcagccttccaagtagctgggattataggcacgcaccaccacacctggctaatttttgtatttttagtagagacagggtttcaccctgttggccaggctagtctgtaactcctgaccttgtgatctgctggcctcagcctcccaaagtgctgggattgcaggcgtaagccaccacacccggccttatttaccatctttaatccattttagtactatgggtgagtacatggaattgaagtctggcttaaatcttcagaaagttatatatctattttattttatttttttgagacagagtctcgctgtgtcacccaggctggagtacagtgccacaatcttggctcactgcaacctctgagtcccaggttcaagcgatactcatgcctcagcctcctgagtagctgggactacaggcgtgcaccaccacacctggctaattttttgtatttttagtagagacggggtttcgccatgttgcccaggctggtctctcctgagctcaggcaatcggccaccttggcctctgaaagtgctagaattacgggcatgagccaccgcatccagccagaaagatacatatctaattctagaaatagcatgcagtatcagtcatagtaacagccatgtgctgacctaaataaaatttcttgatattgtgtatttaacctgaagtattgagctagtttttttgttttgttttttggtgctgaacattttggtctaattctttggcttcttagaacattttaaaaaatctatgttttgctatcagccaaagtaaatgtgttcacactaacatataagttactaaccttcattatacagcaaagctaaaaagtggtgggatatttggggtcttaatgaaaattgtatcatttaattccataaatattaaaatatttgggtaccttttaagctttttttctttccttctataatggtggtacaagttctatattcattcagtttaatctcatttgaaattgtttaaatcagagtacatgtaaatatttgtgggtttttttttttggtttatagactcgagctttccttttacacagttttttttagggaaaaactaaagctattaggaaattctaaatcttgttgatgaagagttgggctttctttgatataattaataaaagggatgtatggtatttatggctgggtaggaccagaaatgcactttgtattacagagtgttaaggctggttgctatagtatggaacagaaacacctctccttggtctccctagtaatggttcaagttcttcccaggaagtcttacatattataactttgttcattatctttcccttatagcatcattttcctttttgtagagtggaaatcagactagctgctaaacatattaaggttaatcctccagaaatgtactggggaggcattttagtcacaacaacttacatttggctttggaagttgttaacaaagcatagtcgatgtttttaaatcaaacataatttgtatcttggaacttacattttgacatttgaataaaacaaaaagactaaatgaaaaaaa

SEQ ID NO: 300418 - DNA, 2333 bp, Homo sapiens
gggctgtacggccgggagtaaggcatggtaatcaacaaatacctgttgctgcattgatgctcctaaagcattaccatgtgggctagttccagcaatctgaagcaacaggtaaatcaacaaatacctcaggaaaaacgaggaggtgaagtattggattcttctcatgatgacataaaacttgaaaaaagtaatattttgctgcttggaccaactgggtcaggtaaaactctgctggcacaaaccctagctaaatgccttgatgtcccttttgctatctgtgactgtacaactttgactcaggctggatatgtaggcgaagatattgaatctgtgattgcaaaactactccaagatgccaattataatgtggaaaaagcacaacaaggaattgtctttctggatgaagtagataagattggcagtgtgccaggcattcatcaattacgggatgtaggtggagaaggcgttcagcaagtaagcagttgaatatttttttcaagcccactaaaaggaagggaatacatcaacctcccaaatattggcttattaaaactactagaaggcacaatagtcaatgttccagaaaagaattcccgaaagctccgtggagaaacagttcaagttgatacaacaaacatcctgtttgtggcatctggtgctttcaatggtttagacagaatcatcagcaggaggaaaaatgaaaagtatcttggatttggaacaccatctaatctgggaaaaggcagaagggctgcagctgctgcagaccttgctaatcgaagtggggaatcgaatactcaccaagacattgaagaaaaagatcggttattgcgtcatgtggaagccagagatctgattgagtttggcatgattcctgagtttgtgggacggttgcctgtggtggttccattgcatagcctagatgagaaaacacttgtacaaatattaactgaccaccacacccggccttatttaccatctttaatccattttagtactatgggtgagtacatggaattgaagtctggcttaaatcttcagaaagttatatatctattttattttatttttttgagacagagtctcgctgtgtcacccaggctggagtacagtgccacaatcttggctcactgcaacctctgagtcccaggttcaagcgatactcatgcctcagcctcctgagtagctgggactacaggcgtgcaccaccacacctggctaattttttgtatttttagtagagacggggtttcgccatgttgcccaggctggtctctcctgagctcaggcaatcggccaccttggcctctgaaagtgctagaattacgggcatgagccaccgcatccagccagaaagatacatatctaattctagaaatagcatgcagtatcagtcatagtaacagccatgtgctgacctaaataaaatttcttgatattgtgtatttaacctgaagtattgagctagtttttttgttttgttttttggtgctgaacattttggtctaattctttggcttcttagaacattttaaaaaatctatgttttgctatcagccaaagtaaatgtgttcacactaacatataagttactaaccttcattatacagcaaagctaaaaagtggtgggatatttggggtcttaatgaaaattgtatcatttaattccataaatattaaaatatttgggtaccttttaagctttttttctttccttctataatggtggtacaagttctatattcattcagtttaatctcatttgaaattgtttaaatcagagtacatgtaaatatttgtgggtttttttttttggtttatagactcgagctttccttttacacagttttttttagggaaaaactaaagctattaggaaattctaaatcttgttgatgaagagttgggctttctttgatataattaataaaagggatgtatggtatttatggctgggtaggaccagaaatgcactttgtattacagagtgttaaggctggttgctatagtatggaacagaaacacctctccttggtctccctagtaatggttcaagttcttcccaggaagtcttacatattataactttgttcattatctttcccttatagcatcattttcctttttgtagagtggaaatcagactagctgctaaacatattaaggttaatcctccagaaatgtactggggaggcattttagtcacaacaacttacatttggctttggaagttgttaacaaagcatagtcgatgtttttaaatcaaacataatttgtatcttggaacttacattttgacatttgaataaaacaaaaagactaaatgaaaaaaa

SEQ ID NO: 300419 - DNA, 3157 bp, Homo sapiens
cgcgcgcaagctccccgggcccagtaggctgggggtgggggtagaaggagaaggaggggaagggaggggggggttgggtgtctactctggtgaatagacggctgtggggcagagaagcgtgaaggcctggctgccgggcaggtgaactctccacggggtctagggcccgcgaaagggttcggaaccgagtcagcgcgccttgcgggcaggattcacgccgctgtgacccggaggtcctcagggggcgaagccccggcctaggcctcgcggagatgcccagctgcggtgcttgtacttgcggcgcggcggccgtccggctcatcacctcctcactcgcctccgcgcagagaggtatttctggtggtcgcattcatatgtcagttttaggaaggcttgggacatttgaaactcagattctgcaaagagctcctcttagatcctttacagaaacaccagcatactttgcctcaaaagatgggataagtaaagatggttctggagatggaaataagaaatcagcaagtgagggaagtagtaagaaatcaggctctgggaattctgggaaaggtggaaaccagctgcgctgtcctaaatgtggcgacttgtgcacacatgtagagacctttgtatcatccacccgttttgtcaagtgtgaaaagtgtcatcatttttttgttgtgctatctgaagcagactcaaagaaaagcataattaaagaacctgaatcagcagcagaagctgtaaaattggcattccaacagaaaccaccacctccccctaagaagatttataactacctcgacaagtatgttgttggccagtcatttgctaagaaggtgctttcagttgctgtgtacaatcattataagagaatatataataatatcccagctaatctgagacagcaagcagaggttgagaagcagacatcattaacaccaagagagttagaaataagaagacgggaggatgagtacagatttacaaaattgcttcagattgctggaattagcccacatggtaatgctttaggagcatcaatgcagcaacaggtaaatcaacaaatacctcaggaaaaacgaggaggtgaagtattggattcttctcatgatgacataaaacttgaaaaaagtaatattttgctgcttggaccaactgggtcaggtaaaactctgctggcacaaaccctagctaaatgccttgatgtcccttttgctatctgtgactgtacaactttgactcaggctggatatgtaggcgaagatattgaatctgtgattgcaaaactactccaagatgccaattataatgtggaaaaagcacaacaaggaattgtctttctggatgaagtagataagattggcagtgtgccaggcattcatcaattacgggatgtaggtggagaaggcgttcagcaaggcttattaaaactactagaaggcacaatagtcaatgttccagaaaagaattcccgaaagctccgtggagaaacagttcaagttgatacaacaaacatcctgtttgtggcatctggtgctttcaatggtttagacagaatcatcagcaggaggaaaaatgaaaagtatcttggatttggaacaccatctaatctgggaaaaggcagaagggctgcagctgctgcagaccttgctaatcgaagtggggaatcgaatactcaccaagacattgaagaaaaagatcggttattgcgtcatgtggaagccagagatctgattgagtttggcatgattcctgagtttgtgggacggttgcctgtggtggttccattgcatagcctagatgagaaaacacttgtacaaatattaactgaccaccacacccggccttatttaccatctttaatccattttagtactatgggtgagtacatggaattgaagtctggcttaaatcttcagaaagttatatatctattttattttatttttttgagacagagtctcgctgtgtcacccaggctggagtacagtgccacaatcttggctcactgcaacctctgagtcccaggttcaagcgatactcatgcctcagcctcctgagtagctgggactacaggcgtgcaccaccacacctggctaattttttgtatttttagtagagacggggtttcgccatgttgcccaggctggtctctcctgagctcaggcaatcggccaccttggcctctgaaagtgctagaattacgggcatgagccaccgcatccagccagaaagatacatatctaattctagaaatagcatgcagtatcagtcatagtaacagccatgtgctgacctaaataaaatttcttgatattgtgtatttaacctgaagtattgagctagtttttttgttttgttttttggtgctgaacattttggtctaattctttggcttcttagaacattttaaaaaatctatgttttgctatcagccaaagtaaatgtgttcacactaacatataagttactaaccttcattatacagcaaagctaaaaagtggtgggatatttggggtcttaatgaaaattgtatcatttaattccataaatattaagttctatattcattcagtttaatctcatttgaaattgtttaaatcagagtacatgtaaatatttgtgggtttttttttttggtttatagactcgagctttccttttacacagttttttttagggaaaaactaaagctattaggaaattctaaatcttgttgatgaagagttgggctttctttgatataattaataaaagggatgtatggtatttatggctgggtaggaccagaaatgcactttgtattacagagtgttaaggctggttgctatagtatggaacagaaacacctctccttggtctccctagtaatggttcaagttcttcccaggaagtcttacatattataactttgttcattatctttcccttatagcatcattttcctttttgtagagtggaaatcagactagctgctaaacatattaaggttaatcctccagaaatgtactggggaggcattttagtcacaacaacttacatttggctttggaagttgttaacaaagcatagtcgatgtttttaaatcaaacataatttgtatcttggaacttacattttgacatttgaataaaacaaaaagactaaatgaaaaaaa

SEQ ID NO: 300420 - DNA, 1359 bp, Homo sapiens
aatgcatgacactaacttcccaattggttctgtaaaaaaggcccatttttcttaccaagttgtctgatttatttaccatcttttttttttttttttttttaattgagcggagtctcacgctgtcccaagctgaagtgcagtggtgcgatcttggctcactgcaacctccgcctcccaggttcaagcaattttcctgcctcagccttccaagtagctgggattataggcacgcaccaccacacctggctaatttttgtatttttatagagacggggtttcgccatgttgcccaggctggtctctcctgagctcaggcaatcggccaccttggcctctgaaagtgctagaattacgggcatgagccaccgcatccagccagaaagatacatatctaattctagaaatagcatgcagtatcagtcatagtaacagccatgtgctgacctaaataaaatttcttgatattgtgtatttaacctgaagtattgagctagtttttttgttttgttttttggtgctgaacattttggtctaattctttggcttcttagaacattttaaaaaatctatgttttgctatcagccaaagtaaatgtgttcacactaacatataagttactaaccttcattatacagcaaagctaaaaagtggtgggatatttggggtcttaatgaaaattgtatcatttaattccataaatattaaaatatttgggtaccttttaagctttttttctttccttctataatggtggtacaagttctatattcattcagtttaatctcatttgaaattgtttaaatcagagtacatgtaaatatttgtgggtttttttttttggtttatagactcgagctttccttttacacagttttttttagggaaaaactaaagctattaggaaattctaaatcttgttgatgaagagttgggctttctttgatataattaataaaagggatgtatggtatttatggctgggtaggaccagaaatgcactttgtattacagagtgttaaggctggttgctatagtatggaacagaaacacctctccttggtctccctagtaatggttcaagttcttcccaggaagtcttacatattataactttgttcattatctttcccttatagcatcattttcctttttgtagagtggaaatcagactagctgctaaacatattaaggttaatcctccagaaatgtactggggaggcattttagtcacaacaacttacatttggctttggaagttgttaacaaagcatagtcgatgtttttaaatcaaacataatttgtatcttggaacttacattttgacatttgaataaaacaaaaagactaaatgaaaaaaa

SEQ ID NO: 300421 - DNA, 3193 bp, Homo sapiens
cgcgcgcaagctccccgggcccagtaggctgggggtgggggtagaaggagaaggaggggaagggaggggggggttgggtgtctactctggtgaatagacggctgtggggcagagaagcgtgaaggcctggctgccgggcaggtgaactctccacggggtctagggcccgcgaaagggttcggaaccgagtcagcgcgccttgcgggcaggattcacgccgctgtgacccggaggtcctcagggggcgaagccccggcctaggcctcgcggagatgcccagctgcggtgcttgtacttgcggcgcggcggccgtccggctcatcacctcctcactcgcctccgcgcagagaggtatttctggtggtcgcattcatatgtcagttttaggaaggcttgggacatttgaaactcagattctgcaaagagctcctcttagatcctttacagaaacaccagcatactttgcctcaaaagatgggataagtaaagatggttctggagatggaaataagaaatcagcaagtgagggaagtagtaagaaatcaggctctgggaattctgggaaaggtggaaaccagctgcgctgtcctaaatgtggcgacttgtgcacacatgtagagacctttgtatcatccacccgttttgtcaagtgtgaaaagtgtcatcatttttttgttgtgctatctgaagcagactcaaagaaaagcataattaaagaacctgaatcagcagcagaagctgtaaaattggcattccaacagaaaccaccacctccccctaagaagatttataactacctcgacaagtatgttgttggccagtcatttgctaagaaggtgctttcagttgctgtgtacaatcattataagagaatatataataatatcccagctaatctgagacagcaagcagaggttgagaagcagacatcattaacaccaagagagttagaaataagaagacgggaggatgagtacagatttacaaaattgcttcagattgctggaattagcccacatggtaatgctttaggagcatcaatgcagcaacaggtaaatcaacaaatacctcaggaaaaacgaggaggtgaagtattggattcttctcatgatgacataaaacttgaaaaaagtaatattttgctgcttggaccaactgggtcaggtaaaactctgctggcacaaaccctagctaaatgccttgatgtcccttttgctatctgtgactgtacaactttgactcaggctggatatgtaggcgaagatattgaatctgtgattgcaaaactactccaagatgccaattataatgtggaaaaagcacaacaaggaattgtctttctggatgaagtagataagattggcagtgtgccaggcattcatcaattacgggatgtaggtggagaaggcgttcagcaaggcttattaaaactactagaaggcacaatagtcaatgttccagaaaagaattcccgaaagctccgtggagaaacagttcaagttgatacaacaaacatcctgtttgtggcatctggtgctttcaatggtttagacagaatcatcagcaggaggaaaaatgaaaagtatcttggatttggaacaccatctaatctgggaaaaggcagaagggctgcagctgctgcagaccttgctaatcgaagtggggaatcgaatactcaccaagacattgaagaaaaagatcggttattgcgtcatgtggaagccagagatctgattgagtttggcatgattcctgagtttgtgggacggttgcctgtggtggttccattgcatagcctagatgagaaaacacttgtacaaatattaactgaccaccacacccggccttatttaccatctttaatccattttagtactatgggtgagtacatggaattgaagtctggcttaaatcttcagaaagttatatatctattttattttatttttttgagacagagtctcgctgtgtcacccaggctggagtacagtgccacaatcttggctcactgcaacctctgagtcccaggttcaagcgatactcatgcctcagcctcctgagtagctgggactacaggcgtgcaccaccacacctggctaattttttgtatttttagtagagacggggtttcgccatgttgcccaggctggtctctcctgagctcaggcaatcggccaccttggcctctgaaagtgctagaattacgggcatgagccaccgcatccagccagaaagatacatatctaattctagaaatagcatgcagtatcagtcatagtaacagccatgtgctgacctaaataaaatttcttgatattgtgtatttaacctgaagtattgagctagtttttttgttttgttttttggtgctgaacattttggtctaattctttggcttcttagaacattttaaaaaatctatgttttgctatcagccaaagtaaatgtgttcacactaacatataagttactaaccttcattatacagcaaagctaaaaagtggtgggatatttggggtcttaatgaaaattgtatcatttaattccataaatattaaaatatttgggtaccttttaagctttttttctttccttctataatggtggtacaagttctatattcattcagtttaatctcatttgaaattgtttaaatcagagtacatgtaaatatttgtgggtttttttttttggtttatagactcgagctttccttttacacagttttttttagggaaaaactaaagctattaggaaattctaaatcttgttgatgaagagttgggctttctttgatataattaataaaagggatgtatggtatttatggctgggtaggaccagaaatgcactttgtattacagagtgttaaggctggttgctatagtatggaacagaaacacctctccttggtctccctagtaatggttcaagttcttcccaggaagtcttacatattataactttgttcattatctttcccttatagcatcattttcctttttgtagagtggaaatcagactagctgctaaacatattaaggttaatcctccagaaatgtactggggaggcattttagtcacaacaacttacatttggctttggaagttgttaacaaagcatagtcgatgtttttaaatcaaacataatttgtatcttggataagtggcagacgagatcctcgtgaacgcc

SEQ ID NO: 300422 - DNA, 362 bp, Homo sapiens
caggcggattgcctgagctcaggagttcaagaccagcctggacaacatggcgaaaccccatctctactaaaaatacaaaaaattggccagatttggtggcttacgcctgtaatcacagctataatcccaaatatatatatatatatatgtttatatatataatcccatatatatgtttatatatatatatatatttgttttgtttgtttctttttccttgagtgaatggattccaatttgtgatttatagaataaaagcacttgtatgtaatctgttttcaatgtgattcattactttttatttctttaggaaaagctgttactagaaccaatgtttgaagtccctaattctgatatcgtat

SEQ ID NO: 300423 - DNA, 451 bp, Homo sapiens
gatttattgaggcatgtctatatttgatgtagatttccttttattttcaggtatttctggtggtcgcattcatatgtcagttttaggaaggcttgggacatttgaaactcagattctgcaaagagctcctcttagatcctttacagaaacaccagcatactttgcctcaaaagatgggataagtaaagatggttctggagatggaaataaggtaattattttatcttattggcatctgtacacattgtgagttccctcctttaaaaaaatataacagtactgtctcttactggcttatatgttttctgtaggaaatatgagatagctaaaatgatctgaataattttatgtaattagatgtttcattttgaaccttaaaatacttttataagcattgcacatagtaagcagtaattaaaatttcttacaccccaaagtagtaaagaagtgt

SEQ ID NO: 300424 - DNA, 2375 bp, Homo sapiens
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacaggtgagctgcacgctgggatgtgggtcatgagccctgggagggggcacgaagagcactggagtaggaatcaggacatccctgccctggtcctgccccctgccaccaacactctcaatgcgctatgtggcctagagcctgtgaccaccctctccggtcctttatccaatagccatccctccagtggttgttaggatcaagggctatcattggagagactgcatgggctcagggctgagaacttgggcactggagcccacgttctcaaaaactcaggatttttaacttgagttaaaaaccccctccctcccaccacttgctctgtgaccttgagcaaatgacttctttctgaacctcagtttcctcgtctggaaaatggggacaacatcaagaccttcctcctagagtgggtgtgacatgaagctactcagcacagaacctagcccagtgtcactctcggcaaatattagccagtaataactggatcctaacagtaatatcagtgtcaagaaagaaagcatgttctaaaatgtagagggggaatatcgagcaatttaaaaccaaaaaagtaaaataaatctaaaacaaaaatcttcaaaatttaaggccagaaaatgtcgatgattgttgccaggctgatgatggtgcttatgagaatgggttagcatcacatgctggctaagaacgtagactcaagacatgaggattgcttgaggccgggagtttgagaccagcctgggcaatatagtgagaccttgtctctacaaaaaaataaaataaaataaaaattagcaggcatggttgtgtgtctggagtcttggctactcagaaggctgaggcaggaagatcgcttgacccctggaggttggctgcaatgagctatgattgcaccattgcactccagcctgggcaacggagcaagatcctctctcaaaaaaaaaaaaaaaaaaaaaaaaagagagagagcacaaattctgaagtcaaggcctgggttcaaatcctagctctgcttcttaccagctgtgtgtccttaggtaaatcacttaactcctctgaaccacagttccattgtatgtaaaatgggcacaacggtagtacctttatactgggatggttgtgaggattaaatgagttaatatgtgtgaggtagctgagcgtggtggtggtgcacctgtagtcttagctgtttgggaggctgaggcagggggatcacttgagcccaggaggtcgaggctgcggtgagtcatgattgcaccactgtactccagcctgggtgacagagcgagacctcatctctaaataaataaatgaatgtgggaagtgcttaaaatgattttgggtgcataatagaaaatacttatgtgatgata

SEQ ID NO: 300425 - DNA, 3077 bp, Homo sapiens
ctatggtcatttcctgcttttgcaattgaagaaagtgctatggtgaaaacaaagatacccttttttccccatcatagggttcatagacccctgaattctgttggtagtgccttggggggatccgtgggccctggtttaagacctccagcggcatggaacattttttcccagctctgtccacttctggataaagcattggcatttctccagcagatagttttctgtgatttgaatttttatttaatgtgaccgtggtccatcacatggatgtgctagactgtatctatccagcctctagtcctcagcattggaagtctgcggacagtgtggggcggttatcaaccacacttacgtaaacatcaggcacccgtattcacttggagaacacacacgccctggggctggccccatgcggggcactgagctccactctcagtatgagcaggaaacgagacagatgtcctccttgctaacatgttgcctgtccttggctccataatttcctcaggatgtctgggatacatttccattttatttatcaaatacttgcatagcatttagtataggctatgagctttacatctataattcaggaatgctcattaggtggtccagatcttatctccacatgaaactgccgcttcgagaagttagtgactggcccaaagtcaccagctaataacaggctgagctgggatttgaaccttaaaagttgtgctccagagcccctattctgaacccttgccctgtggtgccctcctggaagtggagtccttccgtcagagggccgcgtggtcttgaggtttttggctacatgtgattgaattgtggagcgttttagaggacaccacccaaccttcacccaggcccatcccttcccctttctacctctgccagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagagggtatgtgccctcagagtctttaatgcagccttgaagataagcatccagttttcccagcccggcaggctcgtgtatgtgtgtgcgtgtgttttaattggtagcctacgtacagcaatggccccgtaggctatactccatcttcagcaatgccttagaaacaggagcaaacatgttgagggacagtggtagaggattattcatttagggaaagagttctctgctactgatgttaaatcagttgcaggggaaaggacttgatttatttttaaaaattggatttgagcacatcgaacagccaattcaatatggtatctaatttctaagcaaatactaagcatagcaaagcatacagaggggactaagaaaccatagttcctgccttggcctgaccctcactgactttccagggttgcctggccatactctagctgaaagggataacacagaatgaaatgatgctctccccatcccctgaaaggtctagagctgatagtttcatagaataaatagatatgcacccaacaacactgggagaaaaaaatcaaaggagcacaggagagaggcaaatggaatataaggaagggagcaatcagagacagggagggaaaggattttaggtagaagtaatccctgtgtaattgcttgaaggtaagaaagattgcactgtattcgtgcctagtatgcaccaagcactgttgtaggcactggataagtaaaacacagccttagccctcgagcagctcaagaaggtaagtttgaaacagaaaacaacacaggggaaggagtggtcagagagggcttcctggaggaggggtcatttggggttgagtcttgagggatgtataggagttcactagtggaaaattaatgaaatgctgtgtccttctggcccagaaatgtagagaaggggctccttcatggctgccctgagtcatcaggcctctgcgaagacagctcgccctgttgcagcccccttcctgtgatctattccagctgtgattgaggctctcttctcaacccctacagggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctggtaaagccctgtgttcctggagcatttgttgaccgccaactgacaacatgctaggtagtgacctaaccacttagcatgtgtgatttcaccccacagacacttacatggcgctgactctggggcaggccctgtcctaagcactttataaatatcaacccacttaattcttattgcaagagtgagggggtggattctaacatggctccgttttccagatgagtagactgaggcacagagaggttaagtaattttcttaaggttgcacagttggggagttaacctgtcctcacagcagctatactgtttggtttcacctcatcttcgtgtgacccctgactgctttcacagaccctctgctgccctctcccagtgaattccactgtctccagcccctcatgcctcagcagcctctctccatgggcccttcgagaacctctcctgtgcctctggttgctctcggcctcaaagaaaagtctctaacccagcgccttggaaagtgcctgttgcactttccacagtgatggagacgtgctgagtctgcaccgcctatccagcatggctgccaccagctgcacgtggctgctaagcgcttgaaatgtggctggtgcaaccgtagaactaaagtttgtttgtttgtt

SEQ ID NO: 300426 - DNA, 1028 bp, Homo sapiens
cgccgtccctccctcgggctccggtcccctgggtgagccccagcgctggcggcgtgggcccgggactgggcaatgggtggcctcccaggtcgccgccttcccgcggggccccgcccccggcccgccccaaagcgggctataagttagcgccgctctccgcctcggcagtgccagccgccagtggtcgtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgacaggtgtctgttggaccttggacacactcgggacgggtagcccattctgatcggactgaatctgggctgaaacacgtgcaccgtag

SEQ ID NO: 300427 - DNA, 1010 bp, Homo sapiens
  misc_feature (1010)..(1010): n is a, c, g, or t
ccacaatgcctgccgtctcccgctaatgtctccagctgcctggaaggcagcatggggctgcggtcactctggggcagtcttctggcagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaaaaaaaaaaaaaaaaaaaaaaaaaaagggggggcgcgcccttttttttatttattaattataaatatttataataatatgatattttattatcatctagctacttcatgatgcttagtccttgcctcgtacgtcaggagacgagctctcatgtatagtaggaacaaggaagagcagaaagagacgaggcagaaagtagagggagagggaggacgacaaggagacagcagagggcggacaaagagagaaggacgaacacgcaacaactcccggcaacgaaccagatccacatcacaacaacgaacagaaagcgacgcaggcacgcaagacgaatcaaggcagagcgcaaggctacgaacacgcaaggagcggcagcacgaagcaagacagaacacctccaaaagaggaaccaaaaccacgacaacgaagcaaaagaagaactgaacaggagagacacacacacaggaagacgaaagaagcaccagagcaaataagacggggaagcaaaaacggagagcgaagaggcgcaagcacacgagagagagcataaaggagaccaagacaacgtgacacaacaaacggcagcacaagacgaagacgaacaaacaacgccagacagcgataacaacacagaaaagagagaacagcaagaagacacgacgcaacaccgccacgctaccccgcgaccgn

SEQ ID NO: 300428 - DNA, 3971 bp, Homo sapiens
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300429 - DNA, 4066 bp, Homo sapiens
cgccgtccctccctcgggctccggtcccctgggtgagccccagcgctggcggcgtgggcccgggactgggcaatgggtggcctcccaggtcgccgccttcccgcggggccccgcccccggcccgccccaaagcgggctataagttagcgccgctctccgcctcggcagtgccagccgccagtggtcgtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300430 - DNA, 3991 bp, Homo sapiens
gggctcacagtggatccggaagcacaggagaccaagagaccagagataccaggatgagagataggacccctggttgccaggttcgagaagtcctaggctgagtccctggaaatggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300431 - DNA, 4295 bp, Homo sapiens
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccgaaagtgaccagcccctcctcgccctgcccatgactcagacctgcctgtgggggcgggccctcccctccacctggaaaagcagctgctttgagagtgtgcccatcactgtgcctttgagaacccggctggggagtgtcctctttgggaagaagaggcaccgtagaagacaactgagagctaaagacccacttcagatgcgacctttgccacaaactcctaggatatccttgggagaccgctttgctctgagcctcagttttctcacctgggcaaggggtctcaaaggaagcaggtgcttcatgaagtgtaaaaggctgtaggaaggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300432 - DNA, 3547 bp, Homo sapiens
gttgtggtgtggtgttctagaggatcccgagaggtgggacacgggtagggatgccaggcacctcagcactgtgcaggccacggcggcgaagacccagcactggccatacttgacgcgctggcagaagtggttcttccagcgccgcaggatgtccacgctgccgatccaggacatggggctgacgccgtccccgtagttgtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300433 - DNA, 3787 bp, Homo sapiens
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaactggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300434 - DNA, 4109 bp, Homo sapiens
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaaaaaacacaactaacccgcacacacaacaaccaccaacaacacaaccccacagggacccacacagcgcggggcgcgaacaagccgcactcaaggccgcctgtgccacgggtaccggcccccctcttgcaccccgggcgc

SEQ ID NO: 300435 - DNA, 2768 bp, Homo sapiens
tagagaggctgatgcctgtaccgacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300436 - DNA, 2791 bp, Homo sapiens
gacatcatcacgttcgcagtgtgtctcctccttgatcgggcgcccctcgctccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300437 - DNA, 3620 bp, Homo sapiens
ctatggtcatttcctgcttttgcaattgaagaaagtgctatggtgaaaacaaagatacccttttttccccatcatagggttcatagacccctgaattctgttggtagtgccttggggggatccgtgggccctggtttaagacctccagcggcatggaacattttttcccagctctgtccacttctggataaagcattggcatttctccagcagatagttttctgtgatttgaatttttatttaatgtgaccgtggtccatcacatggatgtgctagactgtatctatccagcctctagtcctcagcattggaagtctgcggacagtgtggggcggttatcaaccacacttacgtaaacatcaggcacccgtattcacttggagaacacacacgccctggggctggccccatgcggggcactgagctccactctcagtatgagcaggaaacgagacagatgtcctccttgctaacatgttgcctgtccttggctccataatttcctcaggatgtctgggatacatttccattttatttatcaaatacttgcatagcatttagtataggctatgagctttacatctataattcaggaatgctcattaggtggtccagatcttatctccacatgaaactgccgcttcgagaagttagtgactggcccaaagtcaccagctaataacaggctgagctgggatttgaaccttaaaagttgtgctccagagcccctattctgaacccttgccctgtggtgccctcctggaagtggagtccttccgtcagagggccgcgtggtcttgaggtttttggctacatgtgattgaattgtggagcgttttagaggacaccacccaaccttcacccaggcccatcccttcccctttctacctctgccagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300438 - DNA, 3536 bp, Homo sapiens
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300439 - DNA, 2381 bp, Homo sapiens
gctcctcgctgggaaccctggagccacagtggggagttcagggatccgcccagccattcccccgctgtgtgaccccaagcacattccttcccctctctgtgcctcttggagttgcaagagagttgggaggggtgattctgcatcatgagcaccctcctttctccccttctgcagagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300440 - DNA, 2280 bp, Homo sapiens
agtaacaccgctataaacacataagcttgtaactcttactccctctctcctactacctgactcgcatctgcagagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300441 - DNA, 4452 bp, Homo sapiens
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaaaaaaaaaaaaaaaaaaaaaaaaaaaaaaaaaaaaaaaaaaaaaaaaaaaaaaaaacaaaaaacaaaaacatgtggtggcgcgcgcgccgccggcgcggcccgcaagaagaagatattctacaacaacaccatgctgcgtgggagggcgcgcggaggccaccacacgggcgaggaagaagagagcaaggtggagcaaacggaagtgctgctcagcagggaaaacgacggggagcaagacagcagggcaggggtgggggatctctcccccaccagataaaaagaaatagagaccgcgcgcgcgggagagagaaaaaaccgagaagggtttgtcgccagagaaacaacaaactcaccgagagaggggaggaataactaggcgcgagcgacacacagctaggagagagcaaatataaaacacgagaggaggaacacaaaacgagggcgaagcgagagaaaaagaaaataacagcccccccggagg

SEQ ID NO: 300442 - DNA, 3714 bp, Homo sapiens
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300443 - DNA, 2133 bp, Homo sapiens
ccacgctctgggggtgaaatctgctacacacccgggtatgctgctcagcaacggagcggatagtctgacctccctgggctttgtgacagcggtgacagagagagtagttctcaaaccactccgagttgggattcagttctgctgagcccgccccacagagagagcgtcgacgctctctctgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300444 - DNA, 2428 bp, Homo sapiens
cgccgtccctccctcgggctccggtcccctgggtgagccccagcgctggcggcgtgggcccgggactgggcaatgggtggcctcccaggtcgccgccttcccgcggggccccgcccccggcccgccccaaagcgggctataagttagcgccgctctccgcctcggcagtgccagccgccagtggtcgtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300445 - DNA, 1782 bp, Homo sapiens
gggtggtaatacacgtacaagccttttagggttgtcatgtaggtgaagtaggagcccgccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300446 - DNA, 1783 bp, Homo sapiens
  misc_feature (5)..(5): n is a, c, g, or t
  misc_feature (63)..(63): n is a, c, g, or t
cttcntgccttggtctcccaaagtgctgggataacaggtgtgcaccaccgagcctggccttgntttgtttctaaccggatgtctgcctatttttttttcgagacagagtctgcttctgtcacccaggcgtcatctcagctcaccgcaacctccgcctcccaggttcaagtgatttttccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300447 - DNA, 3604 bp, Homo sapiens
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300448 - DNA, 3732 bp, Homo sapiens
  misc_feature (3640)..(3640): n is a, c, g, or t
  misc_feature (3659)..(3659): n is a, c, g, or t
  misc_feature (3676)..(3676): n is a, c, g, or t
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacaccctgaatttggagggcaagagctgatgactttcattcacattcattagtgctctataagaatctatgtatgcctggctttcctgccaggtgtccttttgggaagaccatacttcctgtctgtgaatgaattagaaggatatttggtatttctggtgtgtaggcatcttctgatgganccaggttaggaatggcagncaccaagctatgatctncacagtgaattctcaatatattaagaaaacccatttaagttttccctcaaatctgg

SEQ ID NO: 300449 - DNA, 3873 bp, Homo sapiens
  misc_feature (3469)..(3469): n is a, c, g, or t
  misc_feature (3595)..(3595): n is a, c, g, or t
  misc_feature (3609)..(3609): n is a, c, g, or t
  misc_feature (3689)..(3689): n is a, c, g, or t
  misc_feature (3706)..(3706): n is a, c, g, or t
  misc_feature (3712)..(3712): n is a, c, g, or t
  misc_feature (3821)..(3821): n is a, c, g, or t
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacaccccaangccccaggagaagagcgaagggacgtactgctgtggcccagttccagttcgtgccatcaaggagggcgacctgagcaccaagtacgatgcgcccttgtctttgcggagtcatgccgacgtggtagnctggatccagcagnacgatgggtctgtgcacaaatccatcaaccgttccctgatcgttgggctgaagatcagcactaagagcgtgggccgagangagcgggaggatatcanccacanctacaaatacccagaggggtcctcagaggagagggaggccttcacaagggcgaaccacctgaacaaactgtccgagaaggaggaggaggaattcgcccaggaggaggangaattcgcccaggaggaggaggaattcgcccaggaggaggaggaattcgccc

SEQ ID NO: 300450 - DNA, 2659 bp, Homo sapiens
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccgggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300451 - DNA, 1049 bp, Homo sapiens
tcatacgctgctctagaggataaacagacgaccacggaatctgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300452 - DNA, 3589 bp, Homo sapiens
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagaagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300453 - DNA, 1069 bp, Homo sapiens
gctcctcgctgggaaccctggagccacagtggggagttcagggatccgcccagccattcccccgctgtgtgaccccaagcacattccttcccctctctgtgcctcttggagttgcaagagagttgggaggggtgattctgcatcatgagcaccctcctttctccccttctgcagagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccgggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300454 - DNA, 3177 bp, Homo sapiens
  misc_feature (3125)..(3125): n is a, c, g, or t
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggaggaggaattcgcccaggaggaggangaattcgcccaggaggaggaggaattcgcccaggaggaggaggaattcgccc

SEQ ID NO: 300455 - DNA, 2239 bp, Homo sapiens
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctggtaaagccctgtgttcctggagcatttgttgaccgccaactgacaacatgctaggtagtgacctaaccacttagcatgtgtgatttcaccccacagacacttacatggcgctgactctggggcaggccctgtcctaagcactttataaatatcaacccacttaattcttattgcaagatgaggctggtccaagtcccctgttggaacctccaatgccaagctcaagctgagatgcgttccctctaagcccccatactgtggttgagttacttgttattctttgatgataagatctggggaatttccgtgtgctggtggacaggaagccaggccctggatggctgaaaggaatccagttgcccccacccctgcctcctttctctgctgcttctttctcttctccttcctgcctccaccctttcatgctctctcctccctcatcccagtgacgttcctcatcccgggatcctctaga

SEQ ID NO: 300456 - DNA, 2514 bp, Homo sapiens
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctggtaaagccctgtgttcctggagcatttgttgaccgccaactgacaacatgctaggtagtgacctaaccacttagcatgtgtgatttcaccccacagacacttacatggcgctgactctggggcaggccctgtcctaagcactttataaatatcaacccacttaattcttattgcaagagtgagggggtggattctaacatggctccgttttccagatgagtagactgaggcacagagaggttaagtaattttcttaaggttgcacagttggggagttaacctgtcctcacagcagctatactgtttggtttcacctcatcttcgtgtgacccctgactgctttcacagaccctctgctgccctctcccagtgaattccactgtctccagcccctcatgcctcagcagcctctctccatgggcccttcgagaacctctcctgtgcctctggttgctctcggcctcaaagaaaagtctctaacccagcgccttggaaagtgcctgttgcactttccacagtgatggagacgtgctgagtctgcaccgcctatccagcatggctgccaccagctgcacgtggctgctaagcgcttgaaatgtggctggtgcaaccgtagaactaaagtttgtttgtttgtttgcttgtttttttattttttttgagatggagtcttactctgttgcccagtctgcagtgcagtggcacgatctcagctcactgcaatctcagcctcccaagtagctgggatta

SEQ ID NO: 300457 - DNA, 2668 bp, Homo sapiens
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatgtaagtgctggctgctctagctttggggcctgggggaagcgggcagatgccggtgggggtagagactgtccttaggtaccaagccctggctgaaaatcccctcctctcatctcccacacagctgtgcccactcccagacaccctggggctagagttcccaccgtcacattctctgtcaatgctgacaccacccatgcacagatctgccacagacctccacagtgacatcatccgtcaataggcgctcacctgcagacacgtgcatcctcacatagacaggtatctgccctccgaatgtccacacatgagcatgcacacacatatgcatgcgtgggtgtttccacatagatacgtagctgcacacatacatacgagcacacacttcttttttacttttttactgtaatgtaacttatatacagtaaaaagcacagatcacctatgtacagctcaatacattttcacacacacggctacctgagcctatccccttgtgcccctaaatgcaccatctgcttttatgcacacggagcggcacatcgatgggttatcctctgagtcgagtgcatactgaggcatcagcgatagaaagcaataaaaagacag

SEQ ID NO: 300458 - DNA, 1929 bp, Homo sapiens
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300459 - DNA, 1780 bp, Homo sapiens
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaatcacatcatgcatgatgtgatttgccacaacagtgaagtccatggacccagggacgtcgagacatcagtgtacccttgtatcatgtgtaggaaaccagaatgtgtccttatttctggttcccaaacaggattactgtg

SEQ ID NO: 300460 - DNA, 1733 bp, Homo sapiens
aacaggcgtgacgccagttctaaatcttgaaacaaaacaaaacttcaaagtacaccaaaatagaacctccttaaagcataaatctcacggagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtcgtgaccaactacaactcggcccatgaccagaacagcaaccttctcatcgagtactagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 300461 - DNA, 1183 bp, Homo sapiens
  misc_feature (476)..(477): n is a, c, g, or t
gctggggccctcactcctccctgagtgcgagtgctaagaggcgtggggaggcgagaagcccgggacctttcctgaacaccttctgtcccaggcagtggtgtcagccctgggctcgggggttcctgtgtccctgacacctcggtggtgtagaaaggacccggccctcgctgctcatccaggccccgagagtccgagacaggatccatctctacaggcgtgtgggggttcaggacacaaggacacccaagttctagttcctgctgcctgctgcctgctgcctggctgtgggctcctgggtattcctctcctccagcaaggctatgggttccccattcacacaaaggggaaggtgctttcctcttttaagagcccttccagccctgttttgtgtgtgtgtatgtgtgtgtgtgtgtgtgtgtgtgtgtgtgtgtgtatacatttaggaggtccaagtgcggtttgttacacggatatannttgagcagtggtgaagtcttgggcttgacattggagacccagtcccatcgtttcagtgcacacccaccagctccttctcgtgctcagagctgctccaaggggagaaagtgtctgtcctagaatgagtggcatgaggtgaactccaggcctgggccagacacaccaaaatcacttcctcccaggcctctgtggagtcagccctcacctctaagtcaccatcgggaccctgagagcattgttccgcactggcatcagccaagcatgctgacttttctcatcctcccaggaacatgctcaccacagagggtgagcagcaggtccctcctgttggggatccactggagacatagccttcagggagaggaaggggaggacagaaggtcctgggcattggcctctggctggaaagtgaggctggtccaagtcccctgttggaacctccaatgccaagctcaagctgagatgcgttccctctaagcccccatactgtggttgagttacttgttattctttgatgataagatctggggaatttccgtgtgctggtggacaggaagccaggccctggatggctgaaaggaatccagttgcccccacccctgcctcctttctctgctgcttctttctcttctccttcctgcctccaccctttcatgctctctcctccctcatcccagtgacgttcctcatcccgggatcctctaga

SEQ ID NO: 300462 - DNA, 698 bp, Homo sapiens
tggtcgcacttggagggtctcgccgccagtggaaggagccaccgcccccgcccgaccatggccgagggtgagtatcagagtcaccgcagccgccactcaggggccccggggcattgggggtcaggacccggtgggagctgaatccctaagtcctgatttggagagcaacaggcagaccgggctgggtgaggaggcgtctcaatgctgcttggagcctcagtttccccatccacactgcataaccattaacccttgcctccctggatcaggtgaggcaatggaacgcgacggggtgttgtaaactgtaaagtactgtcctggcggaccactggcacgtgtcctcagtcagtcagtgggggctggctctctgatgtgtgcctggagctgtgcagggggtgctggcctggcctcagaacacttaggtttgggtggttcttgccagccaggaccaggtggtgtgcatgccacgccggtggtgtgcaagccaagcctggctgagtccttggctccagcggccagagaggagctttcggcatcctatccaggagccttcggaaatcaggcttgttcttcccgccctcacgttctgcaaccctagaccttggccaattgttgagtctcacctataaaataaggacaacagtgtccttattttataggacaaggtttatgagatttgttttcccccaagaccccca

SEQ ID NO: 300463 - DNA, 323 bp, Homo sapiens
ctgccttacggagtccaacctcatcaaggtgcgggccctcctcgtggagccagttatcaacagctacctgctggctgagagggacctctacctggagaatccagaaatcaagatccggggtaagggcaggctgggcaaggggcagggtcccagggcagctcagcgctggggagagggcagatccctacccccaccccacacacctgcatccctgcaagctccagacctttggtgccttagcgatcctcaaatcctagcctcatcgaagaaaagcatcatgaagcctagagaattggggactcgtagcctctaggaatgaatct

SEQ ID NO: 300464 - DNA, 363 bp, Homo sapiens
aggcccccaaaggctctgcgcagaccagcactgtctcctccttcatccacagagaggatgaaagaacatggcaagaggaagactcacagaaccccacagagaagctttgagaattgggctgtctggctctcccatcacccatttggccaccagctttggtcccagctgctgtgccctcgggggatgcattatggccctgaaaggggcccttgtccctttttggggtgtcatcctggctgggtggtatggatttctgctgtaaacatggcccatctgggagaagcccaggtgccacgttttgaacagctctgaaacttaaagctcagaaggctttgaaatgcaaatattttgaaggaaacataa

SEQ ID NO: 300465 - DNA, 2381 bp, Homo sapiens
agcgggcttcctgttccggcgccaggaggagccgcgcgctgctggtgctgttgccgccgctgctctagctgccgtcagtcaggctgcgcccgcgtcttcagggcccagtccctcggacccatcgccgcttctagaccctactgcggtctcggatattgccgggaaaatgtctgatgaattttcgttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccattcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcattccagcctgggtgacagagtgagactgtctcaaaaaaaaaaaaaaattaatgatggtcaaagggtataaaatctcagacaggaagaatatgttttatgctttttttgagttctgttgtacagtgtggtgcctatacttaataatggggtattatacatttcaaaattgatgttctcatcacagaaatgtatttgaagtattgcatatgttaactagcttgatttaactattccatattgtatccacaatttatgatatcactttgtaacccatacatttatacaattataaattgtcaatttacaataaaaaatttttgttgcgtctttttag

SEQ ID NO: 300466 - DNA, 438 bp, Homo sapiens
aagatggcactcaactccacttatttacctgtcaacaaatacagaactgaactgttagccataagcactttacaaacagactcaggaaactatgcagtagacaatgacatagcttaaccagactctgaaaataataataaattgtagatctctgcaactaagtttaaagcagtgtgactgtgttgcttaaatatcaagtattgtttataaccaccaaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatg

SEQ ID NO: 300467 - DNA, 3581 bp, Homo sapiens
agcgggcttcctgttccggcgccaggaggagccgcgcgctgctggtgctgttgccgccgctgctctagctgccgtcagtcaggctgcgcccgcgtcttcagggcccagtccctcggacccatcgccgcttctagaccctactgcggtctcggatattgccgggaaaatgtctgatgaattttcgttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccattcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatgttcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaatgtattttcatggtttcacagatttttcatgttattttattctttaggccccaattctgggcttcctctgagcaagtcccagagccctaattaactgtaaatttgttgtcaaaaaggaagaaaaaagggcctgagatacctctttgcatgtgacctgcattcacctaaggatatctggaaaccacccttcctccgcaaaccctctcagcaacatggtgtcccattgtggtgattttctcttcttttaaggctaggctactcttggtaaccagattatccgtatatatgataatatgaagtcagggaactttctctgtctgtccctactcccctcactcccccactttctgttatgaaagatagttctacttttatcattaactcctacgcatttagtgagggtcacattattaaacttggagtttaccattttcccacaggagatttcgctggcattccttggaactcccaatttcagtagggcaatgaatgaatgaatactttgcagtgctacttttggaaggaatttctgctttttgccttatgattggacaaaatgcagctgtaaaattttaaattgtttttgatatgttattcaatatcccatgaaagtattcacctaaagtggagttatgaaatggatggtgaaataataagaccattctggagcagggcca

SEQ ID NO: 300468 - DNA, 2480 bp, Homo sapiens
agcgggcttcctgttccggcgccaggaggagccgcgcgctgctggtgctgttgccgccgctgctctagctgccgtcagtcaggctgcgcccgcgtcttcagggcccagtccctcggacccatcgccgcttctagaccctactgcggtctcggatattgccgggaaaatgtctgatgaattttcgttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccattcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatg

SEQ ID NO: 300469 - DNA, 2801 bp, Homo sapiens
agcgggcttcctgttccggcgccaggaggagccgcgcgctgctggtgctgttgccgccgctgctctagctgccgtcagtcaggctgcgcccgcgtcttcagggcccagtccctcggacccatcgccgcttctagaccctactgcggtctcggatattgccgggaaaatgtctgatgaattttcgttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccattcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatgtcaagaatgccaaaaaaaaaaaaaaaaaaaaaaaaaaaaaaaaaaaaaaggggggggggggaaaaaatttccccgggggggcccaaatttcgggacccacggtttttgtgacaagggggcccaaagaggaggagcgccggaataaaagcgccaagggagagggcgcgggcggtaaaacacgccgggacggggaacaaccgggcacgcggggaactctggggaagggacccctaactcgggggggggggaccacactgcggcaccaactcccctaagagattaaacagccaagggacataacaactcacaacgagtacagcg

SEQ ID NO: 300470 - DNA, 3668 bp, Homo sapiens
agcgggcttcctgttccggcgccaggaggagccgcgcgctgctggtgctgttgccgccgctgctctagctgccgtcagtcaggctgcgcccgcgtcttcagggcccagtccctcggacccatcgccgcttctagaccctactgcggtctcggatattgccgggaaaatgtctgatgaattttcgttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccatacaacccagtgtggggttaacatcttagttgaggagcctgccttggtcatataaccaaatggaaaagtaccccacttcccctgtgagtcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatgttcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaatgtattttcatggtttcacagatttttcatgttattttattctttaggccccaattctgggcttcctctgagcaagtcccagagccctaattaactgtaaatttgttgtcaaaaaggaagaaaaaagggcctgagatacctctttgcatgtgacctgcattcacctaaggatatctggaaaccacccttcctccgcaaaccctctcagcaacatggtgtcccattgtggtgattttctcttcttttaaggctaggctactcttggtaaccagattatccgtatatatgataatatgaagtcagggaactttctctgtctgtccctactcccctcactcccccactttctgttatgaaagatagttctacttttatcattaactcctacgcatttagtgagggtcacattattaaacttggagtttaccattttcccacaggagatttcgctggcattccttggaactcccaatttcagtagggcaatgaatgaatgaatactttgcagtgctacttttggaaggaatttctgctttttgccttatgattggacaaaatgcagctgtaaaattttaaattgtttttgatatgttattcaatatcccatgaaagtattcacctaaagtggagttatgaaatggatggtgaaataataagaccattctggagcagggcca

SEQ ID NO: 300471 - DNA, 4194 bp, Homo sapiens
agcgggcttcctgttccggcgccaggaggagccgcgcgctgctggtgctgttgccgccgctgctctagctgccgtcagtcaggctgcgcccgcgtcttcagggcccagtccctcggacccatcgccgcttctagaccctactgcggtctcggatattgccgggaaaatgtctgatgaattttcgttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccatgtgagtgttcaatttgttatttaaagtgtactaattgtacatagcacaactgacattgtttctccccagttttggatggaagattaagaaggcttttaagtttttaaaagagggtgtgtgtatattaaataagtaaatttcaaaccttcaggtaaagcatttaaaaggatgaaagcactgttttaagtattccttgtgctaaaaagaagaattttccaaagatccccaaagactttgtaatgtagtaagcagtgtcctcaatagcatcctttaggtaaactctgagattcatttcattgggctttttgttttattattattatttctcagtattgttttatagcatcacaccaaagtacagttcagtaaaagcagtctctacctgtctagcttgatagaggtagatttttagagaatccaaggcaatgagtaggtaatgttcatctttcaagcagttctcgagctcaagattacacccctattctttattgtcagttacatgtaatgctttatgctttactgtcagacaacccagtgtggggttaacatcttagttgaggagcctgccttggtcatataaccaaatggaaaagtaccccacttcccctgtgagtcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatgttcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaatgtattttcatggtttcacagatttttcatgttattttattctttaggccccaattctgggcttcctctgagcaagtcccagagccctaattaactgtaaatttgttgtcaaaaaggaagaaaaaagggcctgagatacctctttgcatgtgacctgcattcacctaaggatatctggaaaccacccttcctccgcaaaccctctcagcaacatggtgtcccattgtggtgattttctcttcttttaaggctaggctactcttggtaaccagattatccgtatatatgataatatgaagtcagggaactttctctgtctgtccctactcccctcactcccccactttctgttatgaaagatagttctacttttatcattaactcctacgcatttagtgagggtcacattattaaacttggagtttaccattttcccacaggagatttcgctggcattccttggaactcccaatttcagtagggcaatgaatgaatgaatactttgcagtgctacttttggaaggaatttctgctttttgccttatgattggacaaaatgcagctgtaaaattttaaattgtttttgatatgttattcaatatcccatgaaagtattcacctaaagtggagttatgaaatggatggtgaaataataagaccattctggagcagggcca

SEQ ID NO: 300472 - DNA, 3400 bp, Homo sapiens
agcgggcttcctgttccggcgccaggaggagccgcgcgctgctggtgctgttgccgccgctgctctagctgccgtcagtcaggctgcgcccgcgtcttcagggcccagtccctcggacccatcgccgcttctagaccctactgcggtctcggatattgccgggaaagacgtatctgttttgtgttccagttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccattcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatgttcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaatgtattttcatggtttcacagatttttcatgttattttattctttaggccccaattctgggcttcctctgagcaagtcccagagccctaattaactgtaaatttgttgtcaaaaaggaagaaaaaagggcctgagatacctctttgcatgtgacctgcattcacctaaggatatctggaaaccacccttcctccgcaaaccctctcagcaacatggtgtcccattgtggtgattttctcttcttttaaggctaggctactcttggtaaccagattatccgtatatatgataatatgaagtcagggaactttctctgtctgtccctactcccctcactcccccactttctgttatgaaagatagttctacttttatcattaactcctacgcatttagtgagggtcacattattaaacttggagtttaccattttcccacaggagatttcgctggcattccttggaactcccaatttcagtagggcaatgaatgaatgaatactttgcagtgctacttttggaaggaatttctgctttttgccttatgattggacaaaatgcagctgtaaaattttaaattgtttttgatatgttattcaatatcccatgaaagtattcacctaaagtggagttatgaaatggatggtgaaataataagaccattctggagcagggcca

SEQ ID NO: 300473 - DNA, 3017 bp, Homo sapiens
ccagccaggaaaaaaaaaaaatctgttaactcttagtacgaaaataactagccagatctctgattagattagtcaaacatccaatccagctataaaggaaaagaaatctttaaagtacccctaaaacttcctccttgcattagtgtaatttctttcttgctatatatattatctaaaaatatttgttttgcaaagtgtatgccagagtaaatgatgtgacttgctgtttggatttattaagcaataaatttactttaagccacagtaaggagttaataaactccatttgcaaaatctagaagttgactttttcttttttctattgcagtcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatgttcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaatgtattttcatggtttcacagatttttcatgttattttattctttaggccccaattctgggcttcctctgagcaagtcccagagccctaattaactgtaaatttgttgtcaaaaaggaagaaaaaagggcctgagatacctctttgcatgtgacctgcattcacctaaggatatctggaaaccacccttcctccgcaaaccctctcagcaacatggtgtcccattgtggtgattttctcttcttttaaggctaggctactcttggtaaccagattatccgtatatatgataatatgaagtcagggaactttctctgtctgtccctactcccctcactcccccactttctgttatgaaagatagttctacttttatcattaactcctacgcatttagtgagggtcacattattaaacttggagtttaccattttcccacaggagatttcgctggcattccttggaactcccaatttcagtagggcaatgaatgaatgaatactttgcagtgctacttttggaaggaatttctgctttttgccttatgattggacaaaatgcagctgtaaaattttaaattgtttttgatatgttattcaatatcccatgaaagtattcacctaaagtggagttatgaaatggatggtgaaataataagaccattctggagcagggcca

SEQ ID NO: 300474 - DNA, 3527 bp, Homo sapiens
agcgggcttcctgttccggcgccaggaggagccgcgcgctgctggtgctgttgccgccgctgctctagctgccgtcagtcaggctgcgcccgcgtcttcagggcccagtccctcggacccatcgccgcttctagaccctactgcggtctcggatattgccgggaaaatgtctgatgaattttcgttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccattcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatctagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatgttcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaatgtattttcatggtttcacagatttttcatgttattttattctttaggccccaattctgggcttcctctgagcaagtcccagagccctaattaactgtaaatttgttgtcaaaaaggaagaaaaaagggcctgagatacctctttgcatgtgacctgcattcacctaaggatatctggaaaccacccttcctccgcaaaccctctcagcaacatggtgtcccattgtggtgattttctcttcttttaaggctaggctactcttggtaaccagattatccgtatatatgataatatgaagtcagggaactttctctgtctgtccctactcccctcactcccccactttctgttatgaaagatagttctacttttatcattaactcctacgcatttagtgagggtcacattattaaacttggagtttaccattttcccacaggagatttcgctggcattccttggaactcccaatttcagtagggcaatgaatgaatgaatactttgcagtgctacttttggaaggaatttctgctttttgccttatgattggacaaaatgcagctgtaaaattttaaattgtttttgatatgttattcaatatcccatgaaagtattcacctaaagtggagttatgaaatggatggtgaaataataagaccattctggagcagggcca

SEQ ID NO: 300475 - DNA, 2916 bp, Homo sapiens
attgggataagctgacaaattagcagtatttagtttaacactggagcaaatataatttgagtaggaagaagagatagcaggtttgggaatctataattatgaagtccattgattttgggagaaaatctgttgctaaaggatttgaagggccatgaacacaatttgggattattactccctataagtataataattttgctagtgacccatactgtccagtgtgccctaaatcatactgctattgtactccctttgttttcaaggactttgcaactggtatttgggggagatttttttttttttttgagacggagtctcgctctgtcgcccatgctggagtgcagtggtgctatcttggttcactgcaagctccatctcccaggttcacaccattctcctgcctcagcctcccaagcagctgggactacaggtgcccgccaccatgcccggctaatttttttttttttttttttttagtaaaaatggggtttcactgtgttagccaggatggtctcgatctcctgacctcgtgatctgcccgccttggcttcccaaagtgctgggattacaggcgtgagccaccacgtccggccgatttttttttttttttttaatgtaagaatggagataaaagggataatataatttgcttttatattgttatttttgtaaagcatcttttcttcaattcttgttggcattctgggccaaaatatttcaggttggttcggtgtggagttaagaaaagcaggcgttttagtggagaaatggggaacagcatcaagaaaggcttttttccttttttcttttttttttggagacagagtcttgccctgtcacccaggctggagtgcaatggcgtgatcttggctcgctgcaacctctgcctccaggttcaaacgattcttctgcctcagcctcccaagtagctgggattacaggtgcccgccaccacacccatttttgtatttttagtagagacgggggtttcaccatgttggccaggtggtctgaaactcctgacctcgtgatccgcctgcctcagcctcccaaagtgctgagattacaggcgtgagccaccatgcgtgacctttttttctttttaaaagggaacaatgttgctttcaaaacaagacatgctaggctgaaactgatttatggaaaagactgcttgttagcaagtatatttggtcttgagggggatacagattatagaatatgctgacatttgggcttcagaggaagaattttcaaatctaatggaaatagttgaggtgttcaggaatgctgtttcttggagttggaagcttaggttttgaaatgttgaaaccaaaaagacaaaaattaaaacatagaccttaggtcgtcattcacacccggttctcaagaatcaagtggagcacttcaaagaccttggcttgtctgtcccatcctgccactttctcatcttttcatgcttttgaagacaccatttacagctctgactcagccctattttgtgtaaagtaatatattgattattcagaaatagacaatacattttttaattacccaaggactgactgttttgtgcattttactgttggttgtcttcagtagagaatagtaatagggcagagaaaagtatatattttgcctcagtcagtcccaccaccacaatggactattgggatattttctaaaaaaccaatcaatttgcccatgattacctcacaaataattagtgctacctggggtactctcaaatatacagcttttgaaactgtagatgaaaaaagctctactcagagtttttgtcaagactgtgcctgggttgaatatcagtcaattgcctacacttctaaacaataagtgccaatgtctcaattttctcaccctgaatgatagaagctagctttatcaaatgccaaggttagaaagcctggaaataaaacttaagcacagacattcaagtttttgaaaagcataagcctaaattcagataaatcacactgatatattgtactatgcatagaaagttgtaggtggcgttcagggaagactttgattttaataaagcaatatttagtattgaagacaaacactttttattttcagatttctgccaagtaaaacagaaattgccaataaaataatcagtattttgtaaatggcaggcaagcttctggctgtcgaaaacatctgagtcatttattcagtagacaatatgtccttgatccaggttctttgccagctataagggaatccctgtccttgagaggctcatagtctataagtaacattacagaatttgttagcatacccattcattattagttttacctaaacgtgttaggatcactactggtggaaattgtaaccagcctttgggcatcttaaagggtgacatgtggcatgccttttttttttttaagaatttaatgtttttcaagattgtagtgttgatcagcgcaacaattcaagtgtgcaaagtaacaggatagtttgcctcttcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaat

SEQ ID NO: 300476 - DNA, 3592 bp, Homo sapiens
attgggataagctgacaaattagcagtatttagtttaacactggagcaaatataatttgagtaggaagaagagatagcaggtttgggaatctataattatgaagtccattgattttgggagaaaatctgttgctaaaggatttgaagggccatgaacacaatttgggattattactccctataagtataataattttgctagtgacccatactgtccagtgtgccctaaatcatactgctattgtactccctttgttttcaaggactttgcaactggtatttgggggagatttttttttttttttgagacggagtctcgctctgtcgcccatgctggagtgcagtggtgctatcttggttcactgcaagctccatctcccaggttcacaccattctcctgcctcagcctcccaagcagctgggactacaggtgcccgccaccatgcccggctaatttttttttttttttttttttagtaaaaatggggtttcactgtgttagccaggatggtctcgatctcctgacctcgtgatctgcccgccttggcttcccaaagtgctgggattacaggcgtgagccaccacgtccggccgatttttttttttttttttaatgtaagaatggagataaaagggataatataatttgcttttatattgttatttttgtaaagcatcttttcttcaattcttgttggcattctgggccaaaatatttcaggttggttcggtgtggagttaagaaaagcaggcgttttagtggagaaatggggaacagcatcaagaaaggcttttttccttttttcttttttttttggagacagagtcttgccctgtcacccaggctggagtgcaatggcgtgatcttggctcgctgcaacctctgcctccaggttcaaacgattcttctgcctcagcctcccaagtagctgggattacaggtgcccgccaccacacccatttttgtatttttagtagagacgggggtttcaccatgttggccaggtggtctgaaactcctgacctcgtgatccgcctgcctcagcctcccaaagtgctgagattacaggcgtgagccaccatgcgtgacctttttttctttttaaaagggaacaatgttgctttcaaaacaagacatgctaggctgaaactgatttatggaaaagactgcttgttagcaagtatatttggtcttgagggggatacagattatagaatatgctgacatttgggcttcagaggaagaattttcaaatctaatggaaatagttgaggtgttcaggaatgctgtttcttggagttggaagcttaggttttgaaatgttgaaaccaaaaagacaaaaattaaaacatagaccttaggtcgtcattcacacccggttctcaagaatcaagtggagcacttcaaagaccttggcttgtctgtcccatcctgccactttctcatcttttcatgcttttgaagacaccatttacagctctgactcagccctattttgtgtaaagtaatatattgattattcagaaatagacaatacattttttaattacccaaggactgactgttttgtgcattttactgttggttgtcttcagtagagaatagtaatagggcagagaaaagtatatattttgcctcagtcagtcccaccaccacaatggactattgggatattttctaaaaaaccaatcaatttgcccatgattacctcacaaataattagtgctacctggggtactctcaaatatacagcttttgaaactgtagatgaaaaaagctctactcagagtttttgtcaagactgtgcctgggttgaatatcagtcaattgcctacacttctaaacaataagtgccaatgtctcaattttctcaccctgaatgatagaagctagctttatcaaatgccaaggttagaaagcctggaaataaaacttaagcacagacattcaagtttttgaaaagcataagcctaaattcagataaatcacactgatatattgtactatgcatagaaagttgtaggtggcgttcagggaagactttgattttaataaagcaatatttagtattgaagacaaacactttttattttcagatttctgccaagtaaaacagaaattgccaataaaataatcagtattttgtaaatggcaggcaagcttctggctgtcgaaaacatctgagtcatttattcagtagacaatatgtccttgatccaggttctttgccagctataagggaatccctgtccttgagaggctcatagtctataagtaacattacagaatttgttagcatacccattcattattagttttacctaaacgtgttaggatcactactggtggaaattgtaaccagcctttgggcatcttaaagggtgacatgtggcatgccttttttttttttaagaatttaatgtttttcaagattgtagtgttgatcagcgcaacaattcaagtgtgcaaagtaacaggatagtttgcctcttcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaatgtattttcatggtttcacagatttttcatgttattttattctttaggccccaattctgggcttcctctgagcaagtcccagagccctaattaactgtaaatttgttgtcaaaaaggaagaaaaaagggcctgagatacctctttgcatgtgacctgcattcacctaaggatatctggaaaccacccttcctccgcaaaccctctcagcaacatggtgtcccattgtggtgattttctcttcttttaaggctaggctactcttggtaaccagattatccgtatatatgataatatgaagtcagggaactttctctgtctgtccctactcccctcactcccccactttctgttatgaaagatagttctacttttatcattaactcctacgcatttagtgagggtcacattattaaacttggagtttaccattttcccacaggagatttcgctggcattccttggaactcccaatttcagtagggcaatgaatgaatgaatactttgcagtgctacttttggaaggaatttctgctttttgccttatgattggacaaaatgcagctgtaaaattttaaattgtttttgatatgttattcaatatcccatgaaagtattcacctaaagtggagttatgaaatggatggtgaaataataagaccattctggagcagggcca

SEQ ID NO: 300477 - DNA, 2862 bp, Homo sapiens
attgggataagctgacaaattagcagtatttagtttaacactggagcaaatataatttgagtaggaagaagagatagcaggtttgggaatctataattatgaagtccattgattttgggagaaaatctgttgctaaaggatttgaagggccatgaacacaatttgggattattactccctataagtataataattttgctagtgacccatactgtccagtgtgccctaaatcatactgctattgtactccctttgttttcaaggactttgcaactggtatttgggggagatttttttttttttttgagacggagtctcgctctgtcgcccatgctggagtgcagtggtgctatcttggttcactgcaagctccatctcccaggttcacaccattctcctgcctcagcctcccaagcagctgggactacaggtgcccgccaccatgcccggctaatttttttttttttttttttttagtaaaaatggggtttcactgtgttagccaggatggtctcgatctcctgacctcgtgatctgcccgccttggcttcccaaagtgctgggattacaggcgtgagccaccacgtccggccgatttttttttttttttttaatgtaagaatggagataaaagggataatataatttgcttttatattgttatttttgtaaagcatcttttcttcaattcttgttggcattctgggccaaaatatttcaggttggttcggtgtggagttaagaaaagcaggcgttttagtggagaaatggggaacagcatcaagaaaggcttttttccttttttcttttttttttggagacagagtcttgccctgtcacccaggctggagtgcaatggcgtgatcttggctcgctgcaacctctgcctccaggttcaaacgattcttctgcctcagcctcccaagtagctgggattacaggtgcccgccaccacacccatttttgtatttttagtagagacgggggtttcaccatgttggccaggtggtctgaaactcctgacctcgtgatccgcctgcctcagcctcccaaagtgctgagattacaggcgtgagccaccatgcgtgacctttttttctttttaaaagggaacaatgttgctttcaaaacaagacatgctaggctgaaactgatttatggaaaagactgcttgttagcaagtatatttggtcttgagggggatacagattatagaatatgctgacatttgggcttcagaggaagaattttcaaatctaatggaaatagttgaggtgttcaggaatgctgtttcttggagttggaagcttaggttttgaaatgttgaaaccaaaaagacaaaaattcacttcaaagaccttggcttgtctgtcccatcctgccactttctcatcttttcatgcttttgaagacaccatttacagctctgactcagccctattttgtgtaaagtaatatattgattattcagaaatagacaatacattttttaattacccaaggactgactgttttgtgcattttactgttggttgtcttcagtagagaatagtaatagggcagagaaaagtatatattttgcctcagtcagtcccaccaccacaatggactattgggatattttctaaaaaaccaatcaatttgcccatgattacctcacaaataattagtgctacctggggtactctcaaatatacagcttttgaaactgtagatgaaaaaagctctactcagagtttttgtcaagactgtgcctgggttgaatatcagtcaattgcctacacttctaaacaataagtgccaatgtctcaattttctcaccctgaatgatagaagctagctttatcaaatgccaaggttagaaagcctggaaataaaacttaagcacagacattcaagtttttgaaaagcataagcctaaattcagataaatcacactgatatattgtactatgcatagaaagttgtaggtggcgttcagggaagactttgattttaataaagcaatatttagtattgaagacaaacactttttattttcagatttctgccaagtaaaacagaaattgccaataaaataatcagtattttgtaaatggcaggcaagcttctggctgtcgaaaacatctgagtcatttattcagtagacaatatgtccttgatccaggttctttgccagctataagggaatccctgtccttgagaggctcatagtctataagtaacattacagaatttgttagcatacccattcattattagttttacctaaacgtgttaggatcactactggtggaaattgtaaccagcctttgggcatcttaaagggtgacatgtggcatgccttttttttttttaagaatttaatgtttttcaagattgtagtgttgatcagcgcaacaattcaagtgtgcaaagtaacaggatagtttgcctcttcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaat

SEQ ID NO: 300478 - DNA, 2861 bp, Homo sapiens
attgggataagctgacaaattagcagtatttagtttaacactggagcaaatataatttgagtaggaagaagagatagcaggtttgggaatctataattatgaagtccattgattttgggagaaaatctgttgctaaaggatttgaagggccatgaacacaatttgggattattactccctataagtataataattttgctagtgacccatactgtccagtgtgccctaaatcatactgctattgtactccctttgttttcaaggactttgcaactggtatttgggggagatttttttttttttttgagacggagtctcgctctgtcgcccatgctggagtgcagtggtgctatcttggttcactgcaagctccatctcccaggttcacaccattctcctgcctcagcctcccaagcagctgggactacaggtgcccgccaccatgcccggctaatttttttttttttttttttttagtaaaaatggggtttcactgtgttagccaggatggtctcgatctcctgacctcgtgatctgcccgccttggcttcccaaagtgctgggattacaggcgtgagccaccacgtccggccgatttttttttttttttttaatgtaagaatggagataaaagggataatataatttgcttttatattgttatttttgtaaagcatcttttcttcaattcttgttggcattctgggccaaaatatttcaggttggttcggtgtggagttaagaaaagcaggcgttttagtggagaaatggggaacagcatcaagaaaggcttttttccttttttcttttttttttggagacagagtcttgccctgtcacccaggctggagtgcaatggcgtgatcttggctcgctgcaacctctgcctccaggttcaaacgattcttctgcctcagcctcccaagtagctgggattacaggtgcccgccaccacacccatttttgtatttttagtagagacgggggtttcaccatgttggccaggtggtctgaaactcctgacctcgtgatccgcctgcctcagcctcccaaagtgctgagattacaggcgtgagccaccatgcgtgacctttttttctttttaaaagggaacaatgttgctttcaaaacaagacatgctaggctgaaactgatttatggaaaagactgcttgttagcaagtatatttggtcttgagggggatacagattatagaatatgctgacatttgggcttcagaggaagaattttcaaatctaatggaaatagttgaggtgttcaggaatgctgtttcttggagttggaagcttaggttttgaaatgttgaaaccaaaaagacaaaaattaaaacatagaccttaggtcgtcattcacacccggttctcaagaatcaagtggagcacttcaaagaccttggcttgtctgtcccatcctgccactttctcatcttttcatgcttttgaagacaccatttacagctctgactcagccctattttgtgtaaagtaatatattgattattcagaaatagacaatacattttttaattacccaaggactgactgttttgtgcattttactgttggttgtcttcagtagagaatagtaatagggcagagaaaagtatatattttgcctcagtcagtcccaccaccacaatggactattgggatattttctaaaaaaccaatcaatttgcccatgattacctcacaaataattagtgctacctggggtactctcaaatatacagcttttgaaactgtagatgaaaaaagctctactcagagtttttgtcaagactgtgcctgggttgaatatcagtcaattgcctacacttctaaacaataagtgccaatgtctcaattttctcaccctgaatgatagaagctagctttatcaaatgccaaggttagaaagcctggaaataaaacttaagcacagacattcaagtttttgaaaattgtaggtggcgttcagggaagactttgattttaataaagcaatatttagtattgaagacaaacactttttattttcagatttctgccaagtaaaacagaaattgccaataaaataatcagtattttgtaaatggcaggcaagcttctggctgtcgaaaacatctgagtcatttattcagtagacaatatgtccttgatccaggttctttgccagctataagggaatccctgtccttgagaggctcatagtctataagtaacattacagaatttgttagcatacccattcattattagttttacctaaacgtgttaggatcactactggtggaaattgtaaccagcctttgggcatcttaaagggtgacatgtggcatgccttttttttttttaagaatttaatgtttttcaagattgtagtgttgatcagcgcaacaattcaagtgtgcaaagtaacaggatagtttgcctcttcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaat

SEQ ID NO: 300479 - DNA, 1642 bp, Homo sapiens
agcgggcttcctgttccggcgccaggaggagccgcgcgctgctggtgctgttgccgccgctgctctagctgccgtcagtcaggctgcgcccgcgtcttcagggcccagtccctcggacccatcgccgcttctagaccctactgcggtctcggatattgccgggaaaatgtctgatgaattttcgttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccatgtgagtgttcaatttgttatttaaagtgtactaattgtacatagcacaactgacattgtttctccccagttttggatggaagattaagaaggcttttaagtttttaaaagagggtgtgtgtatattaaataagtaaatttcaaaccttcaggtaaagcatttaaaaggatgaaagcactgttttaagtattccttgtgctaaaaagaagaattttccaaagatccccaaagactttgtaatgtagtaagcagtgtcctcaatagcatcctttaggtaaactctgagattcatttcattgggctttttgttttattattattatttctcagtattgttttatagcatcacaccaaagtacagttcagtaaaagcagtctctacctgtctagcttgatagaggtagatttttagagaatccaaggcaatgagtaggtaatgttcatctttcaagcagttctcgagctcaagattacacccctattctttattgtcagttacatgtaatgctttatgctttactgtcagacaacccagtgtggggttaacatcttagttgaggagcctgccttggtcatataaccaaatggaaaagtaccccacttcccctgtgaggtaagccaaacgagtatccaaacgcagagtaaagattttccttaggaaaaaaaatctgttaactcttttttttttttttttttttttttttttttgagacagtcttgctctgtcacccaggcaagagtgcagtctct

SEQ ID NO: 300480 - DNA, 1144 bp, Homo sapiens
  misc_feature (42)..(42): n is a, c, g, or t
  misc_feature (51)..(51): n is a, c, g, or t
  misc_feature (54)..(55): n is a, c, g, or t
  misc_feature (66)..(67): n is a, c, g, or t
  misc_feature (72)..(72): n is a, c, g, or t
  misc_feature (74)..(75): n is a, c, g, or t
actgcatctacaagtcactctagagcgatcccaccaggcttnggcccctanatnnatgtcatgacnngtgancnncttgcgtaactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaatgtattttcatggtttcacagatttttcatgttattttattctttaggccccaattctgggcttcctctgagcaagtcccagagccctaattaactgtaaatttgttgtcaaaaaggaagaaaaaagggcctgagatacctctttgcatgtgacctgcattcacctaaggatatctggaaaccacccttcctccgcaaaccctctcagcaacatggtgtcccattgtggtgattttctcttcttttaaggctaggctactcttggtaaccagattatccgtatatatgataatatgaagtcagggaactttctctgtctgtccctactcccctcactcccccactttctgttatgaaagatagttctacttttatcattaactcctacgcatttagtgagggtcacattattaaacttggagtttaccattttcccacaggagatttcgctggcattccttggaactcccaatttcagtagggcaatgaatgaatgaatactttgcagtgctacttttggaaggaatttctgctttttgccttatgattggacaaaatgcagctgtaaaattttaaattgtttttgatatgttattcaatatcccatgaaagtattcacctaaagtggagttatgaaatggatggtgaaataataagaccattctggagcagggcca

SEQ ID NO: 300481 - DNA, 1138 bp, Homo sapiens
gtgcaccttgcattcctgctagcctgtctctagagtatccccagccaggctcgggccagattaagatgtcaagtcccactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaatgtattttcatggtttcacagatttttcatgttattttattctttaggccccaattctgggcttcctctgagcaagtcccagagccctaattaactgtaaatttgttgtcaaaaaggaagaaaaaagggcctgagatacctctttgcatgtgacctgcattcacctaaggatatctggaaaccacccttcctccgcaaaccctctcagcaacatggtgtcccattgtggtgattttctcttcttttaaggctaggctactcttggtaaccagattatccgtatatatgataatatgaagtcagggaactttctctgtctgtccctactcccctcactcccccactttctgttatgaaagatagttctacttttatcattaactcctacgcatttagtgagggtcacattattaaacttggagtttaccattttcccacaggagatttcgctggcattccttggaactcccaatttcagtagggcaatgaatgaatgaatactttgcagtgctacttttggaaggaatttctgctttttgccttatgattggacaaaatgcagctgtaaaattttaaattgtttttgatatgttattcaatatcccatgaaagtattcacctaaagtggagttatgaaatggatggtgaaataataagaccattctggagcagggcca

SEQ ID NO: 300482 - DNA, 2905 bp, Homo sapiens
agcgggcttcctgttccggcgccaggaggagccgcgcgctgctggtgctgttgccgccgctgctctagctgccgtcagtcaggctgcgcccgcgtcttcagggcccagtccctcggacccatcgccgcttctagaccctactgcggtctcggatattgccgggaaaatgtctgatgaattttcgttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccattcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatgttcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaat

SEQ ID NO: 300483 - DNA, 3455 bp, Homo sapiens
agcgggcttcctgttccggcgccaggaggagccgcgcgctgctggtgctgttgccgccgctgctctagctgccgtcagtcaggctgcgcccgcgtcttcagggcccagtccctcggacccatcgccgcttctagaccctactgcggtctcggatattgccgggaaaatgtctgatgaattttcgttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccattcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatgttcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaatggcctgagatacctctttgcatgtgacctgcattcacctaaggatatctggaaaccacccttcctccgcaaaccctctcagcaacatggtgtcccattgtggtgattttctcttcttttaaggctaggctactcttggtaaccagattatccgtatatatgataatatgaagtcagggaactttctctgtctgtccctactcccctcactcccccactttctgttatgaaagatagttctacttttatcattaactcctacgcatttagtgagggtcacattattaaacttggagtttaccattttcccacaggagatttcgctggcattccttggaactcccaatttcagtagggcaatgaatgaatgaatactttgcagtgctacttttggaaggaatttctgctttttgccttatgattggacaaaatgcagctgtaaaattttaaattgtttttgatatgttattcaatatcccatgaaagtattcacctaaagtggagttatgaaatggatggtgaaataataagaccattctggagcagggcca

SEQ ID NO: 300484 - DNA, 3559 bp, Homo sapiens
agcgggcttcctgttccggcgccaggaggagccgcgcgctgctggtgctgttgccgccgctgctctagctgccgtcagtcaggctgcgcccgcgtcttcagggcccagtccctcggacccatcgccgcttctagaccctactgcggtctcggatattgccggttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccattcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatgttcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaatgtattttcatggtttcacagatttttcatgttattttattctttaggccccaattctgggcttcctctgagcaagtcccagagccctaattaactgtaaatttgttgtcaaaaaggaagaaaaaagggcctgagatacctctttgcatgtgacctgcattcacctaaggatatctggaaaccacccttcctccgcaaaccctctcagcaacatggtgtcccattgtggtgattttctcttcttttaaggctaggctactcttggtaaccagattatccgtatatatgataatatgaagtcagggaactttctctgtctgtccctactcccctcactcccccactttctgttatgaaagatagttctacttttatcattaactcctacgcatttagtgagggtcacattattaaacttggagtttaccattttcccacaggagatttcgctggcattccttggaactcccaatttcagtagggcaatgaatgaatgaatactttgcagtgctacttttggaaggaatttctgctttttgccttatgattggacaaaatgcagctgtaaaattttaaattgtttttgatatgttattcaatatcccatgaaagtattcacctaaagtggagttatgaaatggatggtgaaataataagaccattctggagcagggcca

SEQ ID NO: 300485 - DNA, 3375 bp, Homo sapiens
tcggatattgccgggaaaatgtctgatgaattttcgttggcagatgcactacctgaacactcccctgcccctctgctgtgagcaatacgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccattcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatgttcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaatgtattttcatggtttcacagatttttcatgttattttattctttaggccccaattctgggcttcctctgagcaagtcccagagccctaattaactgtaaatttgttgtcaaaaaggaagaaaaaagggcctgagatacctctttgcatgtgacctgcattcacctaaggatatctggaaaccacccttcctccgcaaaccctctcagcaacatggtgtcccattgtggtgattttctcttcttttaaggctaggctactcttggtaaccagattatccgtatatatgataatatgaagtcagggaactttctctgtctgtccctactcccctcactcccccactttctgttatgaaagatagttctacttttatcattaactcctacgcatttagtgagggtcacattattaaacttggagtttaccattttcccacaggagatttcgctggcattccttggaactcccaatttcagtagggcaatgaatgaatgaatactttgcagtgctacttttggaaggaatttctgctttttgccttatgattggacaaaatgcagctgtaaaattttaaattgtttttgatatgttattcaatatcccatgaaagtattcacctaaagtggagttatgaaatggatggtgaaataataagaccattctggagcagggcca

SEQ ID NO: 300486 - DNA, 2864 bp, Homo sapiens
agcgggcttcctgttccggcgccaggaggagccgcgcgctgctggtgctgttgccgccgctgctctagctgccgtcagtcaggctgcgcccgcgtcttcagggcccagtccctcggacccatcgccgcttctagaccctactgcggtctcggatattgccgggaaaatgtctgatgaattttcgttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccattcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatgtcaagaatgccaaatgctgccagttttttggtttgatagctacctccttctaagaaagcaaaatggttacctttgagaggaacattcagtgtttaatcatcccttatgttaactagatgatagattcaagcttttagaaatgagaaagtagaaactaatttgttaagatattttcagactgcggaatgttgttagctttttctttcacttctcttcaaggacaggtgttagctgtctacaatactgttgaactctgttgtcaaagtagcccccttagtctacaaggcaggtagccttggcttgaattatcaatatcaaaatgtcagttaaccatggagggataaagtaatgtgaaaagtgagatggctgcaaagatagctctcc

SEQ ID NO: 300487 - DNA, 2931 bp, Homo sapiens
ggggcataaacaactgttccagtggccgcaccgcttccacacaggtgaagtctggagtaccaccctagcatgcatactccatgcaccacttactagggtatctgtaatcacgcagccatctcgaggtatcttcctatcactaacatccacaggtcaactgcgctgtgtcacaacggtagccgtttcagtgaacctatactggatgactgccagtcaattgaccgtggatggacctcgccatttcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagtaaatcattcggatgtgatttttatttggttttcatggaaagttaaagtgataaagtatattgaatagttctttgacagaatttgtttaaactatgaaactacacacttaaaaatctaagatgtggattattgttagaatctgcaacttcattggcaaattatttcaagtatttttctataatcactttccccttctaaataaataaacttcgagaataacccatcataatccaaacaaatgatgcctcaacattttgagctgctctgtcggacaaataaacctggtcctcttgaggttatattttggatatacatttttaaactgtcagtaattattgtcagatgtggagttcaatagccagccagtgttcatttttatccttgagcttttagtaaaaacttcctggttttatttttagtcattgggtcatacagcactaaagtctgctatttatggaaactaacttttttgtttttaatccaggccaacatgtatgtaaattaaatttttagataattgattatctctttgtactacttgagatttgattatgagatgtgcatattgctttgggaagagctcgaggaaggaaataattctctcctttgttttgaacctcaaactagataaaccctaggaattgcttaactgcaacaagtaattttcattcccacaaaaacctgaggcagctcttttgcccagagcgttccctgtagccacccccaccccacttgcccttggttctttagaaggagcacacacatcccttgattcctccctgatgtggtaaactggcacactccaggggtctaaaacataaaacagttgtgtttagggaaccttaagtcatgcagacatgactgttctctttgtacaagtgtgaatcaaaatatgtatctctttttcagagtctggttaagctatgtcattgtctactgcatagtttcctgagtctgtttgtaaagtgcttatggctaacagttcagttctgtatttgttgacaggtaaataagtggagttgagtgccatctttgaaaaaattaccctctagctctaacactgaaaataataataaattgtagatctctgcaactaagtttaaagcagtgtgactgtgttgcttaaatatcaagtattgtttataaccaccaaaaaaaaaaaagccctggtagttttttggcaccttatgtttaaatcagattcttagatttggagtagacctgaccttgttatttattagataacattttgaatgtatccattggatttctaaaatgtattgtgaatttctcagacaaacaggatttatgctggagctctgttttgcttagaaataaaatatttagtagtttatttctgctctaattaaaatgttcactttacccctggataaaggcactttcactgcctgtcactgatcagcagatactgacttgttgccattaagtgaacttgacttcttatgtgtgctctatgagtttgttgtaattttcttcttgaaattgtgatttttcactgacagtaatgacaaatttaatgtatgtaattgtctatgcattttaagttaaactgcctaaaatgtgatttgagacatatacatatgtttgtattataaattgtaagcaatcagtttgagatactaggttttatcacctgctgctgtatttgtaaacaaagacaaatgttgctttaagaagtaattataattaggaataggctatggatgtgatacttggtattttttaagataaacttgtttgcttttgtgtattatacctggaaactttttttaaaaaatgtattttcatggtttcacagatttttcatgttattttattctttaggccccaattctgggcttcctctgagcaagtcccagagccctaattaactgtaaatttgttgtcaaaaaggaagaaaaaagggcctgagatacctctttgcatgtgacctgcattcacctaaggatatctggaaaccacccttcctccgcaaaccctctcagcaacatggtgtcccattgtggtgattttctcttcttttaaggctaggctactcttggtaaccagattatccgtatatatgataatatgaagtcagggaactttctctgtctgtccctactcccctcactcccccactttctgttatgaaagatagttctacttttatcattaactcctacgcatttagtgagggtcacattattaaacttggagtttaccattttcccacaggagatttcgctggcattccttggaactcccaatttcagtagggcaatgaatgaatgaatactttgcagtgctacttttggaaggaatttctgctttttgccttatgattggacaaaatgcagctgtaaaattttaaattgtttttgatatgttattcaatatcccatgaaagtattcacctaaagtggagttatgaaatggatggtgaaataataagaccattctggagcagggcca

SEQ ID NO: 300488 - DNA, 1107 bp, Homo sapiens
agcgggcttcctgttccggcgccaggaggagccgcgcgctgctggtgctgttgccgccgctgctctagctgccgtcagtcaggctgcgcccgcgtcttcagggcccagtccctcggacccatcgccgcttctagaccctactgcggtctcggatattgccgggaaaatgtctgatgaattttcgttggcagatgcactacctgaacactcccctgccaaaacctctgctgtgagcaatacaaaacctggccaacctcctcaaggctggccaggctccaacccttggaataatccgagtgctccatcttcagtgccatctggactcccaccaagtgcaacaccctccactgtgccttttggaccagcaccaacaggaatgtatccctccgtgcctcccaccggaccacctccaggacccccagcaccctttcctccttccggaccatcatgtcccccacctggtggtccttatccagccccaactgtgccgggccctggccccacagggccatatcctacaccaaatatgccctttccagagctacccagaccatatggtgcacccacagatccagctgcagctggtcctttaggtccatggggatccatgtcttctggaccttgggcgccaggaatgggagggcagtatcctacccctaatatgccatatccatctccaggcccatatcccgctcctcctcctccccaagcccctggggcagcaccacctgttccatggggcaccgttccaccaggagcctggggaccaccagcaccatatcctgcccctacaggatcgtatcccacaccaggactctatcctactcccagtaatcctttccaagtgccttcaggaccttctggtgctccaccaatgcctggtggcccccattcttaccattaagttaacaatggacgaagagatgacgctttgctttttgaagtacatgtatatgcacatgaatgcatatataaaaattgctggtttcactattagagggcattcatgaaagaacaactcttgcacctctcagagaagataactgcctcttgtacttggatgcgtagtacatcatatgtatacaatcagataaaagcatagaagta

SEQ ID NO: 300489 - DNA, 757 bp, Homo sapiens
agtgtatgtatctgcctgttgcttatgattcacagtattcctgctggaagggttcatttttctgaggcttgaggagaagttgcttgtccaggattctgttcttccttgggtccttggattctcacgctgctgtcgtttttcctgttcagtcctaatccagacctctgtggtctgtcacatagcaccctcctccctctctgtgagtctcctgcttggctctgtcatattcctctttttttccttttctagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatg

SEQ ID NO: 300490 - DNA, 837 bp, Homo sapiens
tgactttaagccttcaggcagaactcccaggtgctaatccgtcagtccggcagccgaagcctgagctcaccaccttcagacaccaccagcctccttcagatgcccaaggatgcctgacaaatgtcattttctacacatcttatgatgtgagaaggattgagaagtactgaccagagacacagctacatccctcccttccacaagctgcaatcagtggataataaagaagagtttaataagcatatcctgaccttcctaaagtgtaatgttgcataaacataaagattctggctgcctctggtgcttagaatctatgtcgtgtaggccgggcacaatgattattatactcagttgtatccttggctgcctaaagtgatgccaggcccttggctctgtccagagttcctcttgaggaaaatgaccacgctcagctgctgcctttgttctgtttggttttcagacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggagggtgagtcgtggttggccgaggatgagtttcctagaagggccttgctttctgctcttgttgtgtctcgtctttagagtaacaggctcgagagagcacctcagagccaggcagcaccaagccctttctcgatagcttaggaatgattatagtttcccctttcacagagggaagggagaaaacaagcattagagttgcgtgccaggctg

SEQ ID NO: 300491 - DNA, 191 bp, Homo sapiens
gcggccgcctactactactactactgctcgaattcaagcttctaacgatgtacggggacatgttgaattgaactttgtgattttattttttgtttcaaaaaagtttaagaaaatggaaatgggcaacagtgagtgaagacatattttagcactgaatagaatatttttaaaattaaactatttgaaatatg

SEQ ID NO: 300492 - DNA, 1967 bp, Homo sapiens
gagatggcgcaggagtgcggttccacagggtcaggttcctaacacgctggccagagcagggagccgacctccaaactctcagggaagagaaccaggttgcccaccggcggcacctcgcacctcgccctgaccacaagcacgtgcgcccaacccgcctcgcaccccggcccgggtagggggctcaggggactcccggggcactcaggagggacgccccgggcggggcgcgcaggcgcgctgaggccgtgagccccaaggggcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatg

SEQ ID NO: 300493 - DNA, 2184 bp, Homo sapiens
gagatggcgcaggagtgcggttccacagggtcaggttcctaacacgctggccagagcagggagccgacctccaaactctcagggaagagaaccaggttgcccaccggcggcacctcgcacctcgccctgaccacaagcacgtgcgcccaacccgcctcgcaccccggcccgggtagggggctcaggggactcccggggcactcaggagggacgccccgggcggggcgcgcaggcgcgctgaggccgtgagccccaaggggcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatgaaaaaaaaaaagataataaaaaaaaaatttaaaagtaaaaaaaaaaaaaaaaaaccttgagggggggcccgtgcccaaatttgccctatatgggagccgttttacattccattggccgtctttaaaaaacgtcgtgacctggaaaaaccctgggtttcccaaattaaagcgctttgaaaaaaattcccctttttccccagttgcgtaaataccaaaa

SEQ ID NO: 300494 - DNA, 1877 bp, Homo sapiens
aggggattccggcttccggcccggactggagctgcctggcgtcggtgcccgcgcccggcccagcccggggcccgccctcccctcttcctgggcagtggccccgcctgcgtttccaggcttcctcttgataatagcgagtagccctggagtggtgtcagcccgccaggctgagcgctctgcgtattcaggcgttgaagttggggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatgaaaaaaaaaaagataataaaaaaaaaatttaaaagtaaaaaaaaaaaaaaaaaaccttgagggggggcccgtgcccaaatttgccctatatgggagccgttttacattccattggccgtctttaaaaaacgtcgtgacctggaaaaaccctgggtttcccaaattaaagcgctttgaaaaaaattcccctttttccccagttgcgtaaataccaaaa

SEQ ID NO: 300495 - DNA, 2306 bp, Homo sapiens
gagatggcgcaggagtgcggttccacagggtcaggttcctaacacgctggccagagcagggagccgacctccaaactctcagggaagagaaccaggttgcccaccggcggcacctcgcacctcgccctgaccacaagcacgtgcgcccaacccgcctcgcaccccggcccgggtagggggctcaggggactcccggggcactcaggagggacgccccgggcggggcgcgcaggcgcgctgaggccgtgagccccaaggggcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgacggaatctcgctctgtcacccaggctggagtgcattggcgcaatctcggctcactgcaacctctgcctctcaggttcaagcaattctcctgcctcagcctcctgagtagctgggactacagggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatgaaaaaaaaaaagataataaaaaaaaaatttaaaagtaaaaaaaaaaaaaaaaaaccttgagggggggcccgtgcccaaatttgccctatatgggagccgttttacattccattggccgtctttaaaaaacgtcgtgacctggaaaaaccctgggtttcccaaattaaagcgctttgaaaaaaattcccctttttccccagttgcgtaaataccaaaa

SEQ ID NO: 300496 - DNA, 2152 bp, Homo sapiens
gagatggcgcaggagtgcggttccacagggtcaggttcctaacacgctggccagagcagggagccgacctccaaactctcagggaagagaaccaggttgcccaccggcggcacctcgcacctcgccctgaccacaagcacgtgcgcccaacccgcctcgcaccccggcccgggtagggggctcaggggactcccggggcactcaggagggacgccccgggcggggcgcgcaggcgcgctgaggccgtgagccccaaggggcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaagggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatgaaaaaaaaaaagataataaaaaaaaaatttaaaagtaaaaaaaaaaaaaaaaaaccttgagggggggcccgtgcccaaatttgccctatatgggagccgttttacattccattggccgtctttaaaaaacgtcgtgacctggaaaaaccctgggtttcccaaattaaagcgctttgaaaaaaattcccctttttccccagttgcgtaaataccaaaa

SEQ ID NO: 300497 - DNA, 2282 bp, Homo sapiens
gagatggcgcaggagtgcggttccacagggtcaggttcctaacacgctggccagagcagggagccgacctccaaactctcagggaagagaaccaggttgcccaccggcggcacctcgcacctcgccctgaccacaagcacgtgcgcccaacccgcctcgcaccccggcccgggtagggggctcaggggactcccggggcactcaggagggacgccccgggcggggcgcgcaggcgcgctgaggccgtgagccccaaggggcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatggctggagtgcattggcgcaatctcggctcactgcaacctctgcctctcaggttcaagcaattctcctgcctcagcctcctgagtagctgggactacagggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatgaaaaaaaaaaagataataaaaaaaaaatttaaaagtaaaaaaaaaaaaaaaaaaccttgagggggggcccgtgcccaaatttgccctatatgggagccgttttacattccattggccgtctttaaaaaacgtcgtgacctggaaaaaccctgggtttcccaaattaaagcgctttgaaaaaaattcccctttttccccagttgcgtaaataccaaaa

SEQ ID NO: 300498 - DNA, 1849 bp, Homo sapiens
agtgtatgtatctgcctgttgcttatgattcacagtattcctgctggaagggttcatttttctgaggcttgaggagaagttgcttgtccaggattctgttcttccttgggtccttggattctcacgctgctgtcgtttttcctgttcagtcctaatccagacctctgtggtctgtcacatagcaccctcctccctctctgtgagtctcctgcttggctctgtcatattcctctttttttccttttctagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatgaaaaaaaaaaagataataaaaaaaaaatttaaaagtaaaaaaaaaaaaaaaaaaccttgagggggggcccgtgcccaaatttgccctatatgggagccgttttacattccattggccgtctttaaaaaacgtcgtgacctggaaaaaccctgggtttcccaaattaaagcgctttgaaaaaaattcccctttttccccagttgcgtaaataccaaaa

SEQ ID NO: 300499 - DNA, 2013 bp, Homo sapiens
gagatggcgcaggagtgcggttccacagggtcaggttcctaacacgctggccagagcagggagccgacctccaaactctcagggaagagaaccaggttgcccaccggcggcacctcgcacctcgccctgaccacaagcacgtgcgcccaacccgcctcgcaccccggcccgggtagggggctcaggggactcccggggcactcaggagggacgccccgggcggggcgcgcaggcgcgctgaggccgtgagccccaaggggcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatgaaaaaaaaaaagataataaaaaaaaaatttaaaagtaaaaaaaaaaaaaaaaaaccttgagggggggcccgtgcccaaatttgccctatatgggagccgttttacattccattggccgtctttaaaaaacgtcgtgacctggaaaaaccctgggtttcccaaattaaagcgctttgaaaaaaattcccctttttccccagttgcgtaaataccaaaa

SEQ ID NO: 300500 - DNA, 2087 bp, Homo sapiens
gagatggcgcaggagtgcggttccacagggtcaggttcctaacacgctggccagagcagggagccgacctccaaactctcagggaagagaaccaggttgcccaccggcggcacctcgcacctcgccctgaccacaagcacgtgcgcccaacccgcctcgcaccccggcccgggtagggggctcaggggactcccggggcactcaggagggacgccccgggcggggcgcgcaggcgcgctgaggccgtgagccccaaggggcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgggagaagaagtgggtgactgtgggtgacacgtccctgaggatatttaagtgggttcctgtgacagacagcaaggagacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatgaaaaaaaaaaagataataaaaaaaaaatttaaaagtaaaaaaaaaaaaaaaaaaccttgagggggggcccgtgcccaaatttgccctatatgggagccgttttacattccattggccgtctttaaaaaacgtcgtgacctggaaaaaccctgggtttcccaaattaaagcgctttgaaaaaaattcccctttttccccagttgcgtaaataccaaaa

SEQ ID NO: 300501 - DNA, 1780 bp, Homo sapiens
aggggattccggcttccggcccggactggagctgcctggcgtcggtgcccgcgcccggcccagcccggggcccgccctcccctcttcctgggcagtggccccgcctgcgtttccaggcttcctcttgataatagcgagtagccctggagtggtgtcagcccgccaggctgagcgctctgcgtattcaggcgttgaagttggggagaagaagtgggtgactgtgggtgacacgtccctgaggatatttaagtgggttcctgtgacagacagcaaggagacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatgaaaaaaaaaaagataataaaaaaaaaatttaaaagtaaaaaaaaaaaaaaaaaaccttgagggggggcccgtgcccaaatttgccctatatgggagccgttttacattccattggccgtctttaaaaaacgtcgtgacctggaaaaaccctgggtttcccaaattaaagcgctttgaaaaaaattcccctttttccccagttgcgtaaataccaaaa

SEQ ID NO: 300502 - DNA, 1963 bp, Homo sapiens
tgactttaagccttcaggcagaactcccaggtgctaatccgtcagtccggcagccgaagcctgagctcaccaccttcagacaccaccagcctccttcagatgcccaaggatgcctgacaaatgtcattttctacacatcttatgatgtgagaaggattgagaagtactgaccagagacacagctacatccctcccttccacaagctgcaatcagtggataataaagaagagtttaataagcatatcctgaccttcctaaagtgtaatgttgcataaacataaagattctggctgcctctggtgcttagaatctatgtcgtgtaggccgggcacaatgattattatactcagttgtatccttggctgcctaaagtgatgccaggcccttggctctgtccagagttcctcttgaggaaaatgaccacgctcagctgctgcctttgttctgtttggttttcagacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatgaaaaaaaaaaagataataaaaaaaaaatttaaaagtaaaaaaaaaaaaaaaaaaccttgagggggggcccgtgcccaaatttgccctatatgggagccgttttacattccattggccgtctttaaaaaacgtcgtgacctggaaaaaccctgggtttcccaaattaaagcgctttgaaaaaaattcccctttttccccagttgcgtaaataccaaaa

SEQ ID NO: 300503 - DNA, 2243 bp, Homo sapiens
gagatggcgcaggagtgcggttccacagggtcaggttcctaacacgctggccagagcagggagccgacctccaaactctcagggaagagaaccaggttgcccaccggcggcacctcgcacctcgccctgaccacaagcacgtgcgcccaacccgcctcgcaccccggcccgggtagggggctcaggggactcccggggcactcaggagggacgccccgggcggggcgcgcaggcgcgctgaggccgtgagccccaaggggcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgacggaatctcgctctgtcacccaggctggagtgcattggcgcaatctcggctcactgcaacctctgcctctcaggttcaagcaattctcctgcctcagcctcctgagtagctgggactacagggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatgaaaaaaaaaaagataataaaaaaaaaatttaaaagtaaaaaaaaaaaaaaaaaaccttgagggggggcccgtgcccaaatttgccctatatgggagccgttttacattccattggccgtctttaaaaaacgtcgtgacctggaaaaaccctgggtttcccaaattaaagcgctttgaaaaaaattcccctttttccccagttgcgtaaataccaaaa

SEQ ID NO: 300504 - DNA, 1877 bp, Homo sapiens
gagatggcgcaggagtgcggttccacagggtcaggttcctaacacgctggccagagcagggagccgacctccaaactctcagggaagagaaccaggttgcccaccggcggcacctcgcacctcgccctgaccacaagcacgtgcgcccaacccgcctcgcaccccggcccgggtagggggctcaggggactcccggggcactcaggagggacgccccgggcggggcgcgcaggcgcgctgaggccgtgagccccaaggggcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacacatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatg

SEQ ID NO: 300505 - DNA, 1704 bp, Homo sapiens
gagatggcgcaggagtgcggttccacagggtcaggttcctaacacgctggccagagcagggagccgacctccaaactctcagggaagagaaccaggttgcccaccggcggcacctcgcacctcgccctgaccacaagcacgtgcgcccaacccgcctcgcaccccggcccgggtagggggctcaggggactcccggggcactcaggagggacgccccgggcggggcgcgcaggcgcgctgaggccgtgagccccaaggggcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatgaaaaaaaaaaagataataaaaaaaaaatttaaaagtaaaaaaaaaaaaaaaaaaccttgagggggggcccgtgcccaaatttgccctatatgggagccgttttacattccattggccgtctttaaaaaacgtcgtgacctggaaaaaccctgggtttcccaaattaaagcgctttgaaaaaaattcccctttttccccagttgcgtaaataccaaaa

SEQ ID NO: 300506 - DNA, 1487 bp, Homo sapiens
gagatggcgcaggagtgcggttccacagggtcaggttcctaacacgctggccagagcagggagccgacctccaaactctcagggaagagaaccaggttgcccaccggcggcacctcgcacctcgccctgaccacaagcacgtgcgcccaacccgcctcgcaccccggcccgggtagggggctcaggggactcccggggcactcaggagggacgccccgggcggggcgcgcaggcgcgctgaggccgtgagccccaaggggcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatg

SEQ ID NO: 300507 - DNA, 1010 bp, Homo sapiens
gagatggcgcaggagtgcggttccacagggtcaggttcctaacacgctggccagagcagggagccgacctccaaactctcagggaagagaaccaggttgcccaccggcggcacctcgcacctcgccctgaccacaagcacgtgcgcccaacccgcctcgcaccccggcccgggtagggggctcaggggactcccggggcactcaggagggacgccccgggcggggcgcgcaggcgcgctgaggccgtgagccccaaggggcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctctgcaaggaacccactcaggctcatgctggaagacagcccctggatgcgcatgaccttgctttcgttcatgccgccggccaccagctcctggcgcgagggggtaccgagctc

SEQ ID NO: 300508 - DNA, 7968 bp, Homo sapiens
  misc_feature (6244)..(6244): n is a, c, g, or t
tgttgagcatgaaatctctgctcccttaaaaaattattctcggaaaaagatatcccccccgttttccaggttttgagccgcctctccttagggcctggtcgggggaggaaaagttgtaaacaaattgccaccttaaattcgcggtgcgagtctgcggagctgccgggttcattgtgtttacgaggctcgctgaaatgtgtggaatccagggaaggcgagcacccagacgggggcccgccggggccgcggccagcgccggggaaatgccgcgccggggagcagcctgcgccggcctgagcccttccctttgcactcggctgttttttacgtttaaccagaaaggaagggagaggagggaaagatccatgtggctgccctcttccgatcacaaatattgtcgggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccctctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggngctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctggtgtgtgtgtgtgtgtgtgtgtgtcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaagatgattatcatcag

SEQ ID NO: 300509 - DNA, 1009 bp, Homo sapiens
tgttgagcatgaaatctctgctcccttaaaaaattattctcggaaaaagatatcccccccgttttccaggttttgagccgcctctccttagggcctggtcgggggaggaaaagttgtaaacaaattgccaccttaaattcgcggtgcgagtctgcggagctgccgggttcattgtgtttacgaggctcgctgaaatgtgtggaatccagggaaggcgagcacccagacgggggcccgccggggccgcggccagcgccggggaaatgccgcgccggggagcagcctgcgccggcctgagcccttccctttgcactcggctgttttttacgtttaaccagaaaggaagggagaggagggaaagatccatgtggctgccctcttccgatcacaaatattgtcgtaagttgcagctggctgccccacttcctaattcagctcacacagcctctccccacgctatggaaatgcgtcgggagtgaactccggcggccgcgctcaccacgtggatccccacttactaccattctcggcgggggtccagttgggggaacccgcaatatgttgttccaaagagcgctcgcccctagcgcccgtccccgagggtgatggacagagcaggactggtttgctggctcctgaaccttgggctccatcgctgggattacgcagcccctcccttctcagctctggggtgaatattgtctgtgtcgagtggtttctctcctctctacctcggcttcctcttctgtattgcagccccagtgccccaagtcgctcagggatcccgcgggtgggggcgccctgatgtccccgaggtgcagctcccacgctgcggcccggctttatgaccgagccccccatgacgctcagatccgccggggctgcagtctcgagggcgagtccgtgtgccgcggccacccgcgcccccacggctgttgggggctcaccgggcgggtgcgcgcaagcgggcgtgggcgcgcgggccgcgactccccggcgctcactcctc

SEQ ID NO: 300510 - DNA, 7976 bp, Homo sapiens
  misc_feature (6252)..(6252): n is a, c, g, or t
gcggccgcagcggcagcagcgcccgccgtgtgagcagcagcagcggctggtctgtcaaccggagcccgagcccgagcagcctgcggccagcagcgtcctcgcaagccgagcgcccaggcgcgccaggagcccgcagcagcggcagcagcgcgccgggccgcccgggaagcctccgtccccgcggcggcggcggcggcggcggcaacatggcctcggctggtaacgccgccgagccccaggaccgcggcggcggcggcagcggctgtatcggtgccccgggacggccggctggaggcgggaggcgcagacggacgggggggctgcgccgtgctgccgcgccggaccgggactatctgcaccggcccagctactgcgacgccgccttcgctctggagcagatttccaaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccctctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggngctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctggtgtgtgtgtgtgtgtgtgtgtgtcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaagatgattatcatcag

SEQ ID NO: 300511 - DNA, 7820 bp, Homo sapiens
  misc_feature (6096)..(6096): n is a, c, g, or t
gcggccgcagcggcagcagcgcccgccgtgtgagcagcagcagcggctggtctgtcaaccggagcccgagcccgagcagcctgcggccagcagcgtcctcgcaagccgagcgcccaggcgcgccaggagcccgcagcagcggcagcagcgcgccgggccgcccgggaagcctccgtccccgcggcggcggcggcggcggcggcaacatggcctcggctggtaacgccgccgagccccaggaccgcggcggcggcggcagcggctgtatcggtgccccgggacggccggctggaggcgggaggcgcagacggacgggggggctgcgccgtgctgccgcgccggaccgggactatctgcaccggcccagctactgcgacgccgccttcgctctggagcagatttccaaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccctctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggngctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctggtgtgtgtgtgtgtgtgtgtgtgtcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaagatgattatcatcag

SEQ ID NO: 300512 - DNA, 8002 bp, Homo sapiens
  misc_feature (6278)..(6278): n is a, c, g, or t
cggccgcggggggcggggagagggtggctaggctcgcgggagctcgccgggcagggcgcctcccaggaaggcggggaggggagcgcctgtttacccaggagggctgtgctgatagcacgttcctcgagtttactttgctttccttgagtttattgtaaaggggtaaagttttcggatccgtcacgtgaccctgacaggtcctgcctatggcgcggcagaccacccacgccgagggccatggaactgcttaatagaaacaggcttgtaattgtgagtccgcgctgcactccgccgaaagcctccggcggcccagcgcgccggggtttttacactttccgttccttttgtaaagacggaggaggaggagaagaagaagaagaaaacggaggagaagaaaaagacgacaggggagacaaagagacccgcagcgacaaggcaagggggagacgagggaagactgggagaagacggaggagcggaggacgaggaaaggggggccagggaaaaaaaaggaattgatgtgaaatccaagcccagcgtccgcgccatcggcacccgcgctccgagcaggggttgacggccggctatggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccctctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggngctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctggtgtgtgtgtgtgtgtgtgtgtgtcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaagatgattatcatcag

SEQ ID NO: 300513 - DNA, 5824 bp, Homo sapiens
  misc_feature (4100)..(4100): n is a, c, g, or t
gggaggctgaggcacgagaatagcttgaacctgggaggtggaggttacagtgagccgagatggcaccactgcactccagccttggcaacacaagactgtttcaaaaaattatatataaaacaaaacaaaataaaaatgcgattactatgattttatcctttttcctatgggagaacaacccctacaagataaatcagtttaagtgtggtggtgaaaacaaggtatgaggctagacagcttctctttgtccgggaagagtcagtggtgctccctggggtctgaccttgtgcctcttctgttccaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccctctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggngctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctggtgtgtgtgtgtgtgtgtgtgtgtcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaagatgattatcatcag

SEQ ID NO: 300514 - DNA, 1763 bp, Homo sapiens
gcggccgcagcggcagcagcgcccgccgtgtgagcagcagcagcggctggtctgtcaaccggagcccgagcccgagcagcctgcggccagcagcgtcctcgcaagccgagcgcccaggcgcgccaggagcccgcagcagcggcagcagcgcgccgggccgcccgggaagcctccgtccccgcggcggcggcggcggcggcggcaacatggcctcggctggtaacgccgccgagccccaggaccgcggcggcggcggcagcggctgtatcggtgccccgggacggccggctggaggcgggaggcgcagacggacgggggggctgcgccgtgctgccgcgccggaccgggactatctgcaccggcccagctactgcgacgccgccttcgctctggagcagatttccaaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgtgtgtgtgaagcgtacctagggcgggaggcgacatggagacaggggcggccgagctgtatgaccaggtcccttttgggcatcctgcagcacgtgggcaacgtccaggatttcctgcgcgttctctttgcttcctctaccgcaagacagacttctatcgcatgagtccacataattgga

SEQ ID NO: 300515 - DNA, 1386 bp, Homo sapiens
gcggccgcagcggcagcagcgcccgccgtgtgagcagcagcagcggctggtctgtcaaccggagcccgagcccgagcagcctgcggccagcagcgtcctcgcaagccgagcgcccaggcgcgccaggagcccgcagcagcggcagcagcgcgccgggccgcccgggaagcctccgtccccgcggcggcggcggcggcggcggcaacatggcctcggctggtaacgccgccgagccccaggaccgcggcggcggcggcagcggctgtatcggtgccccgggacggccggctggaggcgggaggcgcagacggacgggggggctgcgccgtgctgccgcgccggaccgggactatctgcaccggcccagctactgcgacgccgccttcgctctggagcagatttccaaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcaggtaagccagctcccgaggacaatctatgccctgtagtcttcttcctttcctcaaaagccacttccctcctgacatcggcaagtgtatttgtattaatacttaaaccgttatcc

SEQ ID NO: 300516 - DNA, 724 bp, Homo sapiens
gggattacgcagcccctcccttctcagctctggggtgaatattgtctgtgtcgagtggtttctctcctctctacctcggcttcctcttctgtattgcagccccagtgccccaagtcgctcagggatcccgcgggtgggggcgccctgatgtccccgaggtgcagctcccacgctgcggcccggctttatgaccgagccccccatgacgctcagatccgccggggctgcagtctcgagggcgagtccgtgtgccgcggccacccgcgcccccacggctgttgggggctcaccgggcgggtgcgcgcaagcgggcgtgggcgcgcgggccgcgactccccggcgctcactcctcccttctgcttcgtccccaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaaggtaagagcgcccgccgcggcgcccgcgcccccggcccggtccctcctcgcggttgatagagatattcgccagcgcacacctagagcctggctgcggccggcgaaaccccctgcccgcacccgggggattgtttattgtttgggcgcctggccgggagcca

SEQ ID NO: 300517 - DNA, 325 bp, Homo sapiens
atggagtccttgcctacaaactcctggtgcaaaccggcagccgcgataagcccatcgacatcagccaggtactccagctgctgggcactgagggcgcttccagggctgcggggccgctgccctggtggaggctgcttgacagcgtgtgaccccaccctgtgctctctggagacctaaggcactgggagctggtagaaagaatattgggtgactctaattcacctcctcccaccagctaattgtgtgacctcaggccagccagtgcacctcactttcctcatctgtcaaatgggacaggcgtgttcctaccaccagaacaattgtc

SEQ ID NO: 300518 - DNA, 534 bp, Homo sapiens
cggtagtagtggtgttcaattttgccatggttctgctcatttttcctgcaattctcagcatggatttatatcgacgcgaggacaggagactggatattttctgctgttttacaaggtacattttcagactgctgtggccttttgattgggtgcagaatggtgctgtgagagaactctttcagcctgtggacttataaaggaatgtgggtaacggggtttgtgctggtgtggagaacgtaggggagagattggacagaggctgcttccctagggggacatcagagtccctgggcttccttctcccctgccgcagctgaacagtctcacagccctcaagatgctggttccgatgacccctttttccatcatgaactgatgttgccgattgtaggaatgtttcatatctctgcattagagcagaacaagattgaaaaacacccatctagaaaatatatagtcctttgatggtggtttggttttgtttggaattgtgctttgaaggattcatcatcatggaacttgcttttgaaagcc

SEQ ID NO: 300519 - DNA, 2714 bp, Homo sapiens
gtttcttcaaatgtaagcaaaggatgatcgaacctctgccctcctcacaggtttttgtcaggaccagatgggttgaagtagatgaaagtattctataaattataaaataccccatcattaataaaaagagcacgcacttacaaaatgcagtcttatgtgtcaggcactgttctaatcacttacgtatattaactgatttaatccttgcaacaaccccatgaagaagctactcctatttttttttatatatgattaaactaaggcatagagaagttaagtaaaacagccaggaagctgcgagtcagattataaggactcaatattagcaacaaataagattccagtcttgcttccctttattgtctctcctcattttgagcagtttctcttcattggtcccaagtaggaagacaccatacttgtgtttaggcaacctcagatcacattagctctttaggtaactaatatattatttatttatttcatgtattttttataagcccctctgcagattgtgtatgctaagcgtcctctccccattctgtacctgcatttgattttgaggcttcaaaggcagaattttccattcttccctattatagttcattgttcttaccttataaggttttgtgtgtatgtgtttttaatcttgaccctgtggttttaaaatattcacttcctctgccaccttcacatcatctacaggggtggcaagccctccttccctgtcttcatctacagaggacagagtgaggacagagcctctagagtgtcgtctcttggggttcttttattcagctcattggtcacttacctgccattcaacaaactgtactgtcatcctacccttatttctgcatattatctgcaaagatcatagaaaattctgtcaaacaactcaacgtccaaaaacatgattccggtgatttgtcacttaggtcacctagtttaaaaggagagtttgacacgacttcccctttgggacacccacaccagccctttccccatcccatgtagaagcttgcctttgcccagtgtgaggtgcacgggtcacatttaaggatttcagctcctccctcctttaagaacaccagactaacattcttagcaatgcacattaggatagaggcatctgagcatataaatatttttttctagctagctcccttcttagtttttgtttttggttttagagacagggtctcgctctgtcaccgaggctagagtgcagcggcatgatcatggctcactgtaactttgaactcccggtctcaagcgatcctcctccctcagcctccggatctcttggttttcttacatgagttactctgtatatccacctgtaacattgcttggctttccatttcataccttctgttgttcttagtagctatttctataagctcaggagattttctttgctctttagcaggcttaaagtcctctttttagatcaattatcatctgagaaaatgtgttcttagcattaatgggctatattccatttttacttgaaaccatccttctgttacctatgccatagcttatgactcaaaatccaaattctacctttcagttagtagagtaaaaaagtaataaaaataaaacctatttccccaagtatgtattttcttgtctaagattttcatattacctaatggatgctttttggatatcttcgatggtgccacttgtcccatgaatcagcagggttccctagtggccggcagtgtctggaagcctcagcatactctagcacatgcaccaggaagtcagtcaacatacctggtgattaggagtgttctaatgacctaggcccagtgacaggtttccttaaatttccttgaaccaatgtcattctctgtcaaagtttgtctgcctaagaacctcctacttacctgcactccgtggtgcactttcttcatttcccctcagccttattcccccttccccatcctcttgactctgagttcacttcactgcagtgaaactaatgaggtgctgctgcttttctcaaagccccagatttcccctcctctttcttgccatggcatccagtcctttctcattgcaaccacttggaagtctggcccctgagcctgcttcttcacatgggagctagtattctcagcccatggggagaaacggaggcctgaatacaggcggtcacctaaggtggtgcgtacagtgttgggccacatgtctagtggtgccaggactgagagatcacttacctccaccggttacccaggaggtaacagagactgatccacaatgttcctgaggtgtcttgggcacccataggcaggtgacttctggcttagggcagggttcaggaggctgggcactcacagtttctctttggtccccacagaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattacaaaaaaaag

SEQ ID NO: 300520 - DNA, 4198 bp, Homo sapiens
tcagtcttggccctctcctccctgtccccccggactaaatacgcacaccccctctttctttctgtgcaagcaagagggtcctggaacagcgggttctgaggaggctgggaggcagggctgagaggtggccgagagagaggagtcgcagagccgccagagtgagtcaggcacctccactgggattacagatcccagagcctcgaggagctggaagacatgtccccttctttcctctgcaccccagcccgcagccagccccccaccccccagcccctcctttctccctgctctcaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgagatcaaagaactgcagaccaagctgcgggagctgcagctgcaataccaggctagcatggatgagcaggggcggcttctggtagtgcaggagcagctggaggggcagctgcagtgctgccaggaggagctccgccagctcagggagaagaggccttctgttgtcaaagaagcccgggggaagaatgctaataagaacatgaacaagaatgccaatggggttaaaatgaaaaaggtgaccaagccatgctcggatacttctgagagcgaccttgagaccagaaagagtctggaggtagtgctgtactacaaggccagccagaggaaattagatggactagcaaaagaggaggaaaagaaagaggagatggaggaggaaaaaaaggaagtgaaagaggaagcaaaggagcagtgtggggatgagctagttgctgagccagcagatcctgaggaagctaaatccacagaagatcaggaggaaaatgaagaggacaaagaggaagaggagaaggaagaagacagtgaagaggaggaggatgacgccgactcttcccttgaaagtcccgaagaaaataaccccctcagactttccgagagcaaaaagtcatcccctacccccaaatccccccatcttctccttgcctcttgtaggcctggtggtcatctcggctttgctctggtgctggtgggctgagacgtcgtcctaatgcaggaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattacaaaaaaaag

SEQ ID NO: 300521 - DNA, 438 bp, Homo sapiens
  misc_feature (1)..(1): n is a, c, g, or t
nagaaacccaaatagagcaatctttgaaaacagcactaataatgttggttgattggctatctctcgtgccgaattcggcacgaggtcgtcctaatgcgaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattacaaaaaaaag

SEQ ID NO: 300522 - DNA, 413 bp, Homo sapiens
ggcaagcagcagaggattccgcaactgaacatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaatgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattacaaaaaaaag

SEQ ID NO: 300523 - DNA, 3529 bp, Homo sapiens
agcgggcgttacccgtttccgcctggacggggcgcgcgcggccttagaggcagctgctgttcagaggccgttccggccgccacagcccctccggggcgggaccggccagcggctgggtggccccccagggacacagctctacggggggcggcgagatggaggccataaccagtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgagatcaaagaactgcagaccaagctgcgggagctgcagctgcaataccaggctagcatggatgagcaggggcggcttctggtagtgcaggagcagctggaggggcagctgcagtgctgccaggaggagctccgccagctcagggagaagaggccttctgttgtcaaagaagcccgggggaagaatgctaataagaacatgaacaagaatgccaatggggttaaaatgaaaaaggtgaccaagccatgctcggatacttctgagagcgaccttgagaccagaaagagtctggaggtagtgctgtactacaaggccagccagaggaaattagatggactagcaaaagaggaggaaaagaaagaggagatggaggaggaaaaaaaggaagtgaaagaggaagcaaaggagcagtgtggggatgagctagttgctgagccagcagatcctgaggaagctaaatccacagaagatcaggaggaaaatgaagaggacaaagaggaagaggagaaggaagaagacagtgaagaggaggaggatgacgccgactcttcccttgaaagtcccgaagaaaataaccccctcagactttccgagagcaaaaaggaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattacaaaaaaaag

SEQ ID NO: 300524 - DNA, 3933 bp, Homo sapiens
ctgcgcacccggctcgggtccccgggctcgcggctgcggcttctgctcagggaggcggaaggcggcggcgggagcggtcatggaggcgggcgccggagccggcgcgggagccgcgggctggagctgcccgggcccaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgagatcaaagaactgcagaccaagctgcgggagctgcagctgcaataccaggctagcatggatgagcaggggcggcttctggtagtgcaggagcagctggaggggcagctgcagtgctgccaggaggagctccgccagctcagggagaagaggccttctgttgtcaaagaagcccgggggaagaatgctaataagaacatgaacaagaatgccaatggggttaaaatgaaaaaggtgaccaagccatgctcggatacttctgagagcgaccttgagaccagaaagagtctggaggtagtgctgtactacaaggccagccagaggaaattagatggactagcaaaagaggaggaaaagaaagaggagatggaggaggaaaaaaaggaagtgaaagaggaagcaaaggagcagtgtggggatgagctagttgctgagccagcagatcctgaggaagctaaatccacagaagatcaggaggaaaatgaagaggacaaagaggaagaggagaaggaagaagacagtgaagaggaggaggatgacgccgactcttcccttgaaagtcccgaagaaaataaccccctcagactttccgagagcaaaaaggaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattacaaaaaaaag

SEQ ID NO: 300525 - DNA, 4022 bp, Homo sapiens
aggagagggggtcttccggccctgaggcttgatggggccaccggagggctcctcctaagagggtccttggccctggctcggtggggggtcgcggaaagcggagaggtcagggccctgccgttcgcccatccgggcctcgacttccctcctccggcccccaggctgccgaggggccaccgggcaggggtgggcagggcctggggccggagtcagcgcggactgctaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgagatcaaagaactgcagaccaagctgcgggagctgcagctgcaataccaggctagcatggatgagcaggggcggcttctggtagtgcaggagcagctggaggggcagctgcagtgctgccaggaggagctccgccagctcagggagaagaggccttctgttgtcaaagaagcccgggggaagaatgctaataagaacatgaacaagaatgccaatggggttaaaatgaaaaaggtgaccaagccatgctcggatacttctgagagcgaccttgagaccagaaagagtctggaggtagtgctgtactacaaggccagccagaggaaattagatggactagcaaaagaggaggaaaagaaagaggagatggaggaggaaaaaaaggaagtgaaagaggaagcaaaggagcagtgtggggatgagctagttgctgagccagcagatcctgaggaagctaaatccacagaagatcaggaggaaaatgaagaggacaaagaggaagaggagaaggaagaagacagtgaagaggaggaggatgacgccgactcttcccttgaaagtcccgaagaaaataaccccctcagactttccgagagcaaaaaggaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattacaaaaaaaag

SEQ ID NO: 300526 - DNA, 2929 bp, Homo sapiens
agcgggcgttacccgtttccgcctggacggggcgcgcgcggccttagaggcagctgctgttcagaggccgttccggccgccacagcccctccggggcgggaccggccagcggctgggtggccccccagggacacagctctacggggggcggcgagatggaggccataaccagtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgaggaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattacaaaaaaaag

SEQ ID NO: 300527 - DNA, 3454 bp, Homo sapiens
tcagtcttggccctctcctccctgtccccccggactaaatacgcacaccccctctttctttctgtgcaagcaagagggtcctggaacagcgggttctgaggaggctgggaggcagggctgagaggtggccgagagagaggagtcgcagagccgccagagtgagtcaggcacctccactgggattacagatcccagagcctcgaggagctggaagacatgtccccttctttcctctgcaccccagcccgcagccagccccccaccccccagcccctcctttctccctgctctcaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccgaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgaggaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattacaaaaaaaag

SEQ ID NO: 300528 - DNA, 3449 bp, Homo sapiens
tcagtcttggccctctcctccctgtccccccggactaaatacgcacaccccctctttctttctgtgcaagcaagagggtcctggaacagcgggttctgaggaggctgggaggcagggctgagaggtggccgagagagaggagtcgcagagccgccagagtgagtcaggcacctccactgggattacagatcccagagcctcgaggagctggaagacatgtccccttctttcctctgcaccccagcccgcagccagccccccaccccccagcccctcctttctccctgctctcaggacccacagtgaccactctaggctcctatgaggcttccgagggctgtgagaggaagaagggccaacgctgggggtccctggaacgacgggggatgcaagctatggagggggaggtgttactcccagctctctatgaggaggaagaggaagaggaagaggaggaagaagaggtggaagaagaagaagaacaagtgcagaaaggtggcagtgttggctctctgtcagtcaacaagcaccggggactgagcctcacggagacagagctggaggagctgcgggctcaggtgctgcagctggtggcagaactggaggagacccgggaactggcagggcagcatgaggatgactccttggagctacaggggctcctggaggatgaacggctagccagcgcccagcaggcagaggtgttcaccaagcagatccagcagctccaaggtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagagtgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgaggaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattacaaaaaaaag

SEQ ID NO: 300529 - DNA, 3348 bp, Homo sapiens
agcgggcgttacccgtttccgcctggacggggcgcgcgcggccttagaggcagctgctgttcagaggccgttccggccgccacagcccctccggggcgggaccggccagcggctgggtggccccccagggacacagctctacggggggcggcgagatggaggccataaccagtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgagatcaaagaactgcagaccaagctgcgggagctgcagctgcaataccaggctagcatggatgagcaggggcggcttctggtagtgcaggagcagctggaggggcagctgcagtgctgccaggaggagctccgccagctcagggagaagaggccttctgttgtcaaagaagcccgggggaagaatgctaataagaacatgaacaagaatgccaatggggttaaaatgaaaaaggtgaccaagccatgctcggatacttctgagagcgaccttgagaccagaaagaagatcaggaggaaaatgaagaggacaaagaggaagaggagaaggaagaagacagtgaagaggaggaggatgacgccgactcttcccttgaaagtcccgaagaaaataaccccctcagactttccgagagcaaaaaggaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattacaaaaaaaag

SEQ ID NO: 300530 - DNA, 1720 bp, Homo sapiens
agcgggcgttacccgtttccgcctggacggggcgcgcgcggccttagaggcagctgctgttcagaggccgttccggccgccacagcccctccggggcgggaccggccagcggctgggtggccccccagggacacagctctacggggggcggcgagatggaggccataaccagtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtcatcccctacccccaaatccccccatcttctccttgcctcttgtaggcctggtggtcatctcggctttgctctggtgctggtgggctgagacgtcgtcctaatgcaggaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattacaaaaaaaag

SEQ ID NO: 300531 - DNA, 1363 bp, Homo sapiens
agcgggcgttacccgtttccgcctggacggggcgcgcgcggccttagaggcagctgctgttcagaggccgttccggccgccacagcccctccggggcgggaccggccagcggctgggtggccccccagggacacagctctacggggggcggcgagatggaggccataaccagtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagtcatcccctacccccaaatccccccatcttctccttgcctcttgtaggcctggtggtcatctcggctttgctctggtgctggtgggctgagacgtcgtcctaatgcaggaacatgtttgggttgtggaagcctatggtattcttggctattgcagctgtggctctgtatgtgttacccaacatgcgacagcaggagtcagagttctgcctcatggagtgatggcagaccttggccagcgcgagggcagatccccagtggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattacaaaaaaaag

SEQ ID NO: 300532 - DNA, 3379 bp, Homo sapiens
agcgggcgttacccgtttccgcctggacggggcgcgcgcggccttagaggcagctgctgttcagaggccgttccggccgccacagcccctccggggcgggaccggccagcggctgggtggccccccagggacacagctctacggggggcggcgagatggaggccataaccagtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgagatcaaagaactgcagaccaagctgcgggagctgcagctgcaataccaggctagcatggatgagcaggggcggcttctggtagtgcaggagcagctggaggggcagctgcagtgctgccaggaggagctccgccagctcagggagaagaggccttctgttgtcaaagaagcccgggggaagaatgctaataagaacatgaacaagaatgccaatggggttaaaatgaaaaaggtgaccaagccatgctcggatacttctgagagcgaccttgagaccagaaagagtctggaggtagtgctgtactacaaggccagccagaggaaattagatggactagcaaaagaggaggaaaagaaagaggagatggaggaggaaaaaaaggaagtgaaagaggaagcaaaggagcagtgtggggatgagctagttgctgagccagcagatcctgaggaagctaaatccacagaagatcaggaggaaaatgaagaggacaaagaggaagaggagaaggaagaagacagtgaagaggaggaggatgacgccgactcttcccttgaaagtcccgaagaaaataaccccctcagactttccgagagcaaaaaggtaaccagagccaaagcctagatcaagtgggaagtggggtcttgggctcagataactccgagttaatgggtggccctgccaaggatggatatctccaggagtggaggcctcgcgctctaaggcacaacccttcggggaggtggagatgcagaagtgggagatgagagcagtctgtctgcacgaaatcatgg

SEQ ID NO: 300533 - DNA, 3298 bp, Homo sapiens
agcgggcgttacccgtttccgcctggacggggcgcgcgcggccttagaggcagctgctgttcagaggccgttccggccgccacagcccctccggggcgggaccggccagcggctgggtggccccccagggacacagctctacggggggcggcgagatggaggccataaccagtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgagatcaaagaactgcagaccaagctgcgggagctgcagctgcaataccaggctagcatggatgagcaggggcggcttctggtagtgcaggagcagctggaggggcagctgcagtgctgccaggaggagctccgccagctcagggagaagaggccttctgttgtcaaagaagcccgggggaagaatgctaataagaacatgaacaagaatgccaatggggttaaaatgaaaaaggtgaccaagccatgctcggatacttctgagagcgaccttgagaccagaaagagtctggaggtagtgctgtactacaaggccagccagaggaaattagatggactagcaaaagaggaggaaaagaaagaggagatggaggaggaaaaaaaggaagtgaaagaggaagcaaaggagcagtgtggggatgagctagttgctgagccagcagatcctgaggaagctaaatccacagaagatcaggaggaaaatgaagaggacaaagaggaagaggagaaggaagaagacatggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattacaaaaaaaag

SEQ ID NO: 300534 - DNA, 3494 bp, Homo sapiens
agcgggcgttacccgtttccgcctggacggggcgcgcgcggccttagaggcagctgctgttcagaggccgttccggccgccacagcccctccggggcgggaccggccagcggctgggtggccccccagggacacagctctacggggggcggcgagatggaggccataaccagtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctggatgcctgtgaaagggagttcaaggagtgcatggaatgccttgaaaagcccatggccccccagaacgacaagaatgagatcaaagaactgcagaccaagctgcgggagctgcagctgcaataccaggctagcatggatgagcaggggcggcttctggtagtgcaggagcagctggaggggcagctgcagtgctgccaggaggagctccgccagctcagggagaagaggccttctgttgtcaaagaagcccgggggaagaatgctaataagaacatgaacaagaatgccaatggggttaaaatgaaaaaggtgaccaagccatgctcggatacttctgagagcgaccttgagaccagaaagagtctggaggtagtgctgtactacaaggccagccagaggaaattagatggactagcaaaagaggaggaaaagaaagaggagatggaggaggaaaaaaaggaagtgaaagaggaagcaaaggagcagtgtggggatgagctagttgctgagccagcagatcctgaggaagctaaatccacagaagatcaggaggaaaatgaagaggacaaagaggaagaggagaaggaagaagacagtgaagaggaggaggatgacgccgactcttcccttgaaagtcccgaagaaaataaccccctcagactttccgagagcaaaaagtcatcccctacccccaaatccccccatcttctccttgcctcttgtaggcctggtggtcatctcggctttgctctggtgctggtgggctgagacgtcgtcctaatgcaggtactggtattgcttcctctccttctgagggatagagggagggtgcaggttgccctggcctctcctctttcccttttctcccagctgcttgcttcttgcttgtgccattttataataggtgatgctcaggtctgagttttagttctgacttttccttgggctactgcaaagcctctgacatctctgagcatgtcttcg

SEQ ID NO: 300535 - DNA, 2797 bp, Homo sapiens
agcgggcgttacccgtttccgcctggacggggcgcgcgcggccttagaggcagctgctgttcagaggccgttccggccgccacagcccctccggggcgggaccggccagcggctgggtggccccccagggacacagctctacggggggcggcgagatggaggccataaccagtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataagtgtgacacactgctgtccagactgacagaattgcaggaaaagtacaaggccagccagaaggagatggggcagctgcagatggagcagtgtgagctcctggaggatcagaggaggatgcaggaggagcagggccagctgcaggaagagctgcacaggctcacactgccactgccaaagagtggcctcttactcaagagtcaggagctactcaccaagttagaagacctgtgtgagctgcagctgctctaccaaggcatgcaggaggaacagaagaagctgatacagaaccaagactgtgtattaaaagaacaattagagatccacgaagagctgcgacgtttcaaagagtctcatttccaggaagtgttggagaatcccgatgattccaaattggctaagtcctccaaatgtaatcgaaacaagcaatccaagctgctcatggagcagatgcaggccctgcaggtgatgtatgacgccggtcaggcgaagcaggagctcttgcagcaagagcaagggaggctcctagaggagcggaagaggctgcaggcagacttgcagctctgcctggaagaaatgcagctgcttcaagtccagtccccttctataaaaatgagccttgagtcctacgggaagagctatggtagcatggtccccagcaatgagaactgtcgcaagacttatgataccactgtggatgacaatgagagctattacaagagttacaccagcacccagaccagcagcaagagctttctcaagagctatgacagcagcaccagtgccagtgaggcctatgggaagagttactgcactaccagcaacagcagcattacctataagaagagttacggcagcaccagtagctctgacacctgccagaagagttttgtcagcagctgcactgacgaggaacctgctgagcctgaagacatggagcgctttgaggaaatggttgtgaaagtgctgatcaagctgcaggcggtgcaggccatgtaccagataagccaggaggaacacagccagctgcaagagcagatggaaaagttactggccaagcagaaagacctgaaggaagagctagttgctgagccagcagatcctgaggaagctaaatccacagaagatcaggaggaaaatgaagaggacaaagaggaagaggagaaggaagaagacatggccaccaccctcagctttgggcaggacacactgtgccagaaccctccccatatgttccatgtgtccccatctcctcagcctcagtcacccaggctgaaaaggcttgtggggagcggctgacttccatctcctgccttgtgtaagaacctgagttccttgtaattaaatatcaactgaattacaaaaaaaag

SEQ ID NO: 300536 - DNA, 1734 bp, Homo sapiens
agcgggcgttacccgtttccgcctggacggggcgcgcgcggccttagaggcagctgctgttcagaggccgttccggccgccacagcccctccggggcgggaccggccagcggctgggtggccccccagggacacagctctacggggggcggcgagatggaggccataaccagtgagctgcgttctctacgggaggagatttccctgttagagcatgagaaagaaagcgaacttaaggaaatagaacaggaattgcatttggcccaggctgagatccagagtctgcggcaagcagcagaggattccgcaactgaacatgagagtgacatagcatccctgcaggaggatctctgccggatgcagaatgaacttgaagacatggaacgcattcggggagattatgagatggagatcgcctccctccgtgcagaaatggaaatgaagagctctgaaccatccggtagtttaggtctctcagattactctgggttacaagaagaactgcaggagctgcgggaacgctaccatttcctgaatgaggaataccgggccctgcaggagagcaacagcagcctcacggggcagcttgcagatctggagagtgagaggacacagagagcaacagagagatggctgcagtcccaaacactgagtatgacgtcagcagagtctcagacttcagaaatggatttcttagagcctgatcctgaaatgcagttgttacggcagcagctacgggatgctgaagagcagatgcatggcatgaagaacaagtgtcaggaattgtgttgtgagttggaagagctacagcatcatcgccaggtcagtgaggaggagcagaggcggctgcagagggagctcaagtgtgctcagaatgaggtgcttcggtttcagacctcccacagtgtcacccagaatgaggagctgaagtccagactctgtaccctgcagaaaaaatatgatactagccaggatgagcagaacgagctcttgaagatgcagctgcaacttcagactgagctccggcagctcaaagtcatgaaatccacacttgtagaaaaccagagtgagaaggagttactgtgccggctgcagaagctgcacctccagcaccagaacgtcacatgtgagaaggaaaagctgctggaacggcagcagcagctgcaggaggagctgcagtgccatgaggcagagctgcagcacctcagggatacggtggcctccttcaaagagagcaatgagaaggacacagagacgcacgctcagcttcaggagatgaagcagctgtaccaggccagcaaggacgagctggagcggcagaagcacatgtatgaccagctggagcaggacctcctgctctgccagctggagctgaaagagctcaaggcctcccaccccattccggaggacaaaggaaagtgtgctaataaggtaattgtcgttcagagaggtgacagctcctgggcacttgctccagagagaagaggtacagaggcaaaaagtgaaggcacccaacccaagggcttgatggccttcctaggcaggaagcagaggcagggccacatgctgctaacttcaaaattgtttgccctgaccttgactttgagccagagccacagcttagtaggatcaatacctttggatcccagtctgaacccctgaaagttttacacatgattccatgtatgtagacatttatacaatggtattagaactgtagtgatatctagtcatt

SEQ ID NO: 300537 - DNA, 383 bp, Homo sapiens
ctttagttgtggtagctgtttgaaatggcttaatggccaacagacatagtggccctgagaggtgaggtgtgatgccctctacatatgctcaggggattggctcacagtcccagagcaccgggccacacccttgcactctgacatgctggaagtcatgtttcctggagctagtacagcattgtcatgagattaggagcttcacaggtaacgcagccgccatcctgccctactcccaccccacagagtctggaggtagtgctgtactacaaggccagccagaggaaattagatggactagcaaaagaggaggaaaagaaagaggagatggaggaggaaaaaaaggaagtgaaagaggaagcaaaggagcagtgtggggatgagct

SEQ ID NO: 300538 - DNA, 1249 bp, Homo sapiens
gaagtcatttgtaacaaaaactcattatttacagatgagaaatttatattgtcagcgtaatatctgtgaggctaaacagagctggagagtatataaaagcagtgcgccttggtgcagaagtacagagcttaggacacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttcttta

SEQ ID NO: 300539 - DNA, 1164 bp, Homo sapiens
  misc_feature (3)..(4): n is a, c, g, or t
  misc_feature (7)..(7): n is a, c, g, or t
  misc_feature (14)..(14): n is a, c, g, or t
  misc_feature (21)..(21): n is a, c, g, or t
gannaanaaaaacngggcgantggggaccgggccctttttcgacccacgcgtccggcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttcttta

SEQ ID NO: 300540 - DNA, 1156 bp, Homo sapiens
cggacgcgtgggcggacgcgttgtggtcggcccacgcgtccgcaaaggcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttcttta

SEQ ID NO: 300541 - DNA, 2112 bp, Homo sapiens
  misc_feature (1261)..(1261): n is a, c, g, or t
gaagtcatttgtaacaaaaactcattatttacagatgagaaatttatattgtcagcgtaatatctgtgaggctaaacagagctggagagtatataaaagcagtgcgccttggtgcagaagtacagagcttaggacacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttctttaaaaaaaaaaaanaaaaaaaaaaaaaaaaaaaaaaaaaaaaaaaaaaaaaccaaagagaaaacaaaaaaataaaaaaaaaacaaaaagcaaaaacacagaaagaaaaaaaaaaaaaccaagataacaaagaaacggcgaccaatagaaagagaaaacacaaatacgacaaagacagtgcaggaaagtaataaatcacaaaagacgatgagggagaacaacagcgaaagcagcgcaaaaacacagcgaacggaacccaaacactgcaggagaaaacaaaatacgtaggagcaagacaaaacaaaggacaggaagaaagaaaagaaaacaaagaaaaaaataaagaagaaaaaacagacagtaaaaaacaagtgagcaagaaacccgagaacgaacaaagaaaagaggagaaaaaacaatagaaacgaaaaagagaatctaaaacagagaaaagagatacataaaaaaagaagaataggaaagagaaagaaaaaaaaaaagcaaagaaagaaaaaggaaacagacgaagacaaacagaagaaagaaagaagacaaaacaaggacagaaaaaaaaaggagcatagggaggagagaacgaaagcagggagaaaggacgaaggacaggaaagaaaaaagaaagaaagccagagacgaacgagagaaacaaagcagaagacgcagcgagagacaagaaaaggccggaaagcacgagagcaaaaagaagagagcaaaagaagagaaaaacgagaagaagggaagacaagggaagaggaagaaggagggggaagaaggagaagaggaagagagaagaaagaaacaggaagaagagagagcgaagaggaggaagaggaaggaaaagacacgag

SEQ ID NO: 300542 - DNA, 2005 bp, Homo sapiens
  misc_feature (29)..(30): n is a, c, g, or t
  misc_feature (1154)..(1154): n is a, c, g, or t
cctttttcgacccagcgtccgcggacgcnnggggcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttctttaaaaaaaaaaaanaaaaaaaaaaaaaaaaaaaaaaaaaaaaaaaaaaaaaccaaagagaaaacaaaaaaataaaaaaaaaacaaaaagcaaaaacacagaaagaaaaaaaaaaaaaccaagataacaaagaaacggcgaccaatagaaagagaaaacacaaatacgacaaagacagtgcaggaaagtaataaatcacaaaagacgatgagggagaacaacagcgaaagcagcgcaaaaacacagcgaacggaacccaaacactgcaggagaaaacaaaatacgtaggagcaagacaaaacaaaggacaggaagaaagaaaagaaaacaaagaaaaaaataaagaagaaaaaacagacagtaaaaaacaagtgagcaagaaacccgagaacgaacaaagaaaagaggagaaaaaacaatagaaacgaaaaagagaatctaaaacagagaaaagagatacataaaaaaagaagaataggaaagagaaagaaaaaaaaaaagcaaagaaagaaaaaggaaacagacgaagacaaacagaagaaagaaagaagacaaaacaaggacagaaaaaaaaaggagcatagggaggagagaacgaaagcagggagaaaggacgaaggacaggaaagaaaaaagaaagaaagccagagacgaacgagagaaacaaagcagaagacgcagcgagagacaagaaaaggccggaaagcacgagagcaaaaagaagagagcaaaagaagagaaaaacgagaagaagggaagacaagggaagaggaagaaggagggggaagaaggagaagaggaagagagaagaaagaaacaggaagaagagagagcgaagaggaggaagaggaaggaaaagacacgag

SEQ ID NO: 300543 - DNA, 2027 bp, Homo sapiens
  misc_feature (3)..(4): n is a, c, g, or t
  misc_feature (7)..(7): n is a, c, g, or t
  misc_feature (14)..(14): n is a, c, g, or t
  misc_feature (21)..(21): n is a, c, g, or t
  misc_feature (1176)..(1176): n is a, c, g, or t
gannaanaaaaacngggcgantggggaccgggccctttttcgacccacgcgtccggcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttctttaaaaaaaaaaaanaaaaaaaaaaaaaaaaaaaaaaaaaaaaaaaaaaaaaccaaagagaaaacaaaaaaataaaaaaaaaacaaaaagcaaaaacacagaaagaaaaaaaaaaaaaccaagataacaaagaaacggcgaccaatagaaagagaaaacacaaatacgacaaagacagtgcaggaaagtaataaatcacaaaagacgatgagggagaacaacagcgaaagcagcgcaaaaacacagcgaacggaacccaaacactgcaggagaaaacaaaatacgtaggagcaagacaaaacaaaggacaggaagaaagaaaagaaaacaaagaaaaaaataaagaagaaaaaacagacagtaaaaaacaagtgagcaagaaacccgagaacgaacaaagaaaagaggagaaaaaacaatagaaacgaaaaagagaatctaaaacagagaaaagagatacataaaaaaagaagaataggaaagagaaagaaaaaaaaaaagcaaagaaagaaaaaggaaacagacgaagacaaacagaagaaagaaagaagacaaaacaaggacagaaaaaaaaaggagcatagggaggagagaacgaaagcagggagaaaggacgaaggacaggaaagaaaaaagaaagaaagccagagacgaacgagagaaacaaagcagaagacgcagcgagagacaagaaaaggccggaaagcacgagagcaaaaagaagagagcaaaagaagagaaaaacgagaagaagggaagacaagggaagaggaagaaggagggggaagaaggagaagaggaagagagaagaaagaaacaggaagaagagagagcgaagaggaggaagaggaaggaaaagacacgag

SEQ ID NO: 300544 - DNA, 994 bp, Homo sapiens
  misc_feature (3)..(4): n is a, c, g, or t
  misc_feature (7)..(7): n is a, c, g, or t
  misc_feature (14)..(14): n is a, c, g, or t
  misc_feature (21)..(21): n is a, c, g, or t
gannaanaaaaacngggcgantggggaccgggccctttttcgacccacgcgtccggcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattctttaatgtgtgttccaaattcacatgtgcaaaggtttccaattgctacaatcacctaaaagaagggacaacagacatcgctttggagaaacccacgtattcgaaaacttcacaaaatgcgagaaacccgcatttctataaaggaaaagatccggagagaaactccgctaaacaactgagatgcaa

SEQ ID NO: 300545 - DNA, 457 bp, Homo sapiens
tcagagaaagaaccatcagcatgtctgcggccaagttcttcaacaatggcgacctcttctgggtctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttcttta

SEQ ID NO: 300546 - DNA, 1142 bp, Homo sapiens
  misc_feature (29)..(30): n is a, c, g, or t
cctttttcgacccagcgtccgcggacgcnnggggcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttcttta

SEQ ID NO: 300547 - DNA, 1096 bp, Homo sapiens
  misc_feature (45)..(45): n is a, c, g, or t
  misc_feature (51)..(51): n is a, c, g, or t
ccacgcacacaccacgagtctccccatacccacacatcagcaccngcgccngctagtcacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttcttta

SEQ ID NO: 300548 - DNA, 919 bp, Homo sapiens
  misc_feature (3)..(4): n is a, c, g, or t
  misc_feature (7)..(7): n is a, c, g, or t
  misc_feature (14)..(14): n is a, c, g, or t
  misc_feature (21)..(21): n is a, c, g, or t
gannaanaaaaacngggcgantggggaccgggccctttttcgacccacgcgtccgggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttcttta

SEQ ID NO: 300549 - DNA, 1079 bp, Homo sapiens
gaagtcatttgtaacaaaaactcattatttacagatgagaaatttatattgtcagcgtaatatctgtgaggctaaacagagctggagagtatataaaagcagtgcgccttggtgcagaagtacagagcttaggacacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattctttaatgtgtgttccaaattcacatgtgcaaaggtttccaattgctacaatcacctaaaagaagggacaacagacatcgctttggagaaacccacgtattcgaaaacttcacaaaatgcgagaaacccgcatttctataaaggaaaagatccggagagaaactccgctaaacaactgagatgcaa

SEQ ID NO: 300550 - DNA, 1227 bp, Homo sapiens
gaagtcatttgtaacaaaaactcattatttacagatgagaaatttatattgtcagcgtaatatctgtgaggctaaacagagctggagagtatataaaagcagtgcgccttggtgcagaagtacagagcttaggacacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttcttta

SEQ ID NO: 300551 - DNA, 768 bp, Homo sapiens
  misc_feature (3)..(4): n is a, c, g, or t
  misc_feature (7)..(7): n is a, c, g, or t
  misc_feature (14)..(14): n is a, c, g, or t
  misc_feature (21)..(21): n is a, c, g, or t
gannaanaaaaacngggcgantggggaccgggccctttttcgacccacgcgtccgatgtaagttcttatttggaaggccaagctgccaaggaattcattgcttggctggtgaaaggccgaggaaggcgagatttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttcttta

SEQ ID NO: 300552 - DNA, 1173 bp, Homo sapiens
gaagtcatttgtaacaaaaactcattatttacagatgagaaatttatattgtcagcgtaatatctgtgaggctaaacagagctggagagtatataaaagcagtgcgccttggtgcagaagtacagagcttaggacacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagacccactcagtgatcctgatcagatgaacgaggacaagcgccattcacagggcacattcaccagtgactacagcaagtatctggactccaggcgtgcccaagattttgtgcagtggttgatgaataccaagaggaacaggaataacattgccaaacgtcacgatgaatttgagagacatgctgaagggacctttaccagtgtttcccagaagaggtcgccattgttgaagaacttggccgcagacatgctgatggttctttctctgatgagatgaacaccattcttgataatcttgccgccagggactttataaactggttgattcagaccaaaatcactgacaggaaataactatatcactattcaagatcatcttcacaacatcacctgctagccacgtgggatgtttgaaatgttaagtcctgtaaatttaagaggtgtattctgaggccacattgctttgcatgccaataaataaattttcttttagtgttgtgtagccaaaaattacaaatggaataaagttttatcaaaatattgctaaaatatcagctttaaaatatgaaagtgctagattctgttattttcttcttattttggatgaagtaccccaacctgtttacatttagcgataaaattatttttctatgatataatttgtaaatgtaaattattccgatctgacatatctgcattataataataggagaatagaagaactggtagccacagtggtgaaattggaaagagaactttcttcctgaaacctttgtcttaaaaatactcagctttcaatgtatcaaagatacaattaaataaaattttcaagcttcttta

SEQ ID NO: 300553 - DNA, 781 bp, Homo sapiens
  misc_feature (581)..(581): n is a, c, g, or t
gaagtcatttgtaacaaaaactcattatttacagatgagaaatttatattgtcagcgtaatatctgtgaggctaaacagagctggagagtatataaaagcagtgcgccttggtgcagaagtacagagcttaggacacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttcccaggcagtaagcgtccaaccatctggatcgacacgggcatccattcccgggagtgggtcacccaggccagtggggtctggttgcaaagaagatcactcaagactacgggcaggatgcagctttcaccgccattctcgacaccttggacatcttcctggagatcgtcaccaaccctgatggctttgccttcacgcacagcacgaatcgcatgtggcgcaagactcggtcccacacagcaggctccctctgtatnggcgtggaccccaacaggaactgggacgctggctttgggttgtccggagccagcagtaacccctgctcggagacttaccacggcaagtttgccaattccgaagtggaggtcaagtccattgtagactttgtgaaggaccatgggaaacatcaagggcttcatctcatccacagtaatcccaggtcctcatgtatcctatg

SEQ ID NO: 300554 - DNA, 517 bp, Homo sapiens
gaagtcatttgtaacaaaaactcattatttacagatgagaaatttatattgtcagcgtaatatctgtgaggctaaacagagctggagagtatataaaagcagtgcgccttggtgcagaagtacagagcttaggacacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagagccccgggggaaaattctgtttttttttaatttccaggggaacccccttaaagggttcctgtcaaaaaaaaaaggaaacaacccctttcttggggggcctttccccgggttttacaacagggttgttggtgaccaaggggggccccaaaaaatttttgggggggggttttaaaaaaaaacaaaaagaggagaaaaatttttttcccccccccccccccttttt

SEQ ID NO: 300555 - DNA, 4454 bp, Homo sapiens
gcgcggccttgttgggggcccccgttgcccgcctcccagtagccgcgcctcaccctaggccaggaatggttttagggaagactgttgccggatgacaaggctgtcactattgttctgtactacctgacattatgggaccaggccagccagcttcaacctgtgttcatctagcacctaggacccaacttgatgggaggagtgaccccaaagtacttcagacccagaaccagctgcagtttaataggaatgttcctacacattcaagcaacttggcgatccgatattcttgcccacatgccattagaattgaaaaactgaagcactcatacaatgaatcataccattgtaaagatgcagattgtagagttggtcctgacctgggcagttctgtttcattttccgtcatatcccaagagagacttagctatgctgtccacctagccagaagagatgtgaaacgaagacaatttgaaaaacatataaaagaacatcatctcagaagtcagcctcaaagctctcagaagtgtggacatactaagtataaaatacccgaccacagggtggaaaggaaggaatcaaagagtcaagcagcctgtcagtgtagccaccagccatccaaagtagaaatctccagctctggtgccaaagtatacctttactcatctcatccaggccagtcagatcttactgtgccaaattcgccacccacccatgatccgggacttcagcctcatcccaggataggtgaccacaaaaacataagtgaacagaaaagcctgctagaagtccagcgactccagaaagaactgagcagttgtatccacaaaattgaagaggtaactaaaaaagatagactagaagaagctttggatccagatgaagaacgtcgaatccgtatcaggagacaggagcaagctgctcgctctgcccgaatgctctacgtcctccagcagcaggtaaaagaaatccaggaagaattggataaattgagtccacataaaattaaacacactaagaagtcatgggcaatgtctaagctggcggctgcccatcgaggagccattcgggccttacagatgtttgtcactcagtttactgaccgaggggagcatccacttcctgctcggtgtaaggaactgggcagccttattcgccagctttcactttgttctgtcaagctggatgcagacccttctgttcctgatgtggttatagatattctgcaacaaattgaggctttggaatctctcctggaaaagaaactgtcaccaaaaaaggtgaaaaaatgtttcagtgaaattcggagcagatttcctatcggtagccaaaaggccttggagagatggccaagtacatcaccaaagggtgagaggaggcccctcacagcaaaggacacattcccacaggaaacaagtcgaccttctgtagcaaagcagcttcttgccgataagtatcagcccgatacggagcttccggagacccagaggttgcagagtgagcttgatgtattagatgcggatatagttctggaagaaggaccatttattctagaccaaagtgcaagcttcaaagacgaggtgttagccgtggcaaaaacaaaagcagggaaaaagaagcctgtgactgagaatgtgccgtttaggaagaaagatactctggcgccagcaagacagcaaggactccgcaaagctgaaagaggtagacaaagccaacctcacagtaaaagcagagtgcagcagacaacagtttcatccagattaaaaatgaaccggcagcctgtgaaagaccgcaaggcaccatggatacccccaaaccccacatccccaccagcgtctcctaaatgtgctgcatggctaaaggtgaaaactagccccagagatgccacaaaagagcctctccagcaagaagatcctcaagaggaaagtcacctgacaggtgctgttgagcatgaagcagccaggctcgcttggcttgatgctgaaacttccaaaagattgaaggaactagaagagttaaaagccaaggaaattgacagcatgcaaaaacagaggcttgattggcttgatgctgaaacttctagaagaacaaaggaactgaatgagctcaaagctgaagaaatgtatagactccaacaattgagtgtttctgccacccacttagcagacaaggtagaggaggcagttctggatcgtttgaagcctctcttggtcaaggcccagagagtcaattctactacagaagcaaatattcatttgaaagatggctcgtcagtaaacacagcgaaagcccagcctgcacaggaggttgcagctgttgattttgaatccaacaacattcgtcagcttgatgattttttggaagattgtgccagtgagctctgggctgtgactcatgctaagatcttggggtctgaaaccttagccaccgttgaggacagcaaggatagcccagatctggagatcatgatgcgccgaatggaagagatggaaaaataccaggagtctgttcgtcaaagatataataaaatcgcatatgctgatcctcgactttggatgcaggaagaaaacaatgaccaaaaaatctcagcaataagtgaaaagcctctatctcctcatccaatcagaatcacgaagacagtggatcgcaaggatccagccgtgaacatcatgttagaaaggccctgtaatggcaattccctggatgaaagtgtgggaacagaggaaggatcagagaaaagagaggcccctcttctctccctagccgaagattctcaacagaaagaaggccgagctcccctctttgtcccaccgggtatgcagcacagcatcggtgactactgtagtcgttttgagcagtaccttcggatcatatctcatgaggctgtaggctccttcaacccgtggctgatagctgaaagcttttcagaagagctggtagatgaagctctgggtgctgtggctgctgaacttcaggatatgtgcgaagattatgcagaagctgtgttcacctcagaattcttagaggctgctacataaaggctctctgaggcgaggccgtttgtgtcacactggagaagggatggcaccaccctttgttttggcccacaggaaattttcatcctcagctgtccatccaggcccagaaggtgctgcccactgaaaggaaggcagtgccggggaggtcatcctcactttgcattttcttttgtcatggcaatggttctggaaatgtatgatgcaatgtatcacacttatcagtgcccaggcaacacaacttgattatggcaatattttcagaatgtgtacttttcctattgaaataccatgttcattcctctggctcagtttggtgatgaaaatgttttgaaagataatcgatacgtatatttcacacaaggattcaggttgctgttgaacccttgctggcattgataccaacacaagtgcggctactagctggtcccatcacggggcccctgttttgcatctttggcgatttcctgtcaggacctctggccctactaggctgtagactcagggagagcacagtctggctgtgctgccaaacctctcctctgctgcagtttattccaaacaggagccccctggctgtcagtgcacaataatagacacacatttcttcaacgttccattcctaggtgattttcacatttttagttcctcagcatattttattgctgtgtgttgacacaatctggtataaaaaactttctctggattcagaggaagtttgaggaatcaggagaggaccaggccttctcctgtgcctgggtgaaggtacagacctcgctgtgtctccgatgaggtcagaagtgtctctatttcataccacaaaggaacccaagtgggagtagggaacagatggatggcgcgaagacctctgtgtctccccagagaaaggaagaaacttaagaaccatcatagcctggtcctccaacatcttacagatcatgttttccaagagaaaagcctgtgttttcagaaactctgaattcagaaaaagaaacggaatgtgcgtaagaatcaggccactgcctggaaagactttctctcaattcgtagcctgaggctcagtgaaggaaacatgcagaaagaatgcctgagacgcccccagggaataagggaactctttataacctgtccagtgctgtcatctgggatttttctctgaagtacaagaatttcaggtgatttaagctgcttgatcacacttatttgtgcaaaattgattttcatttaatgttaatgttttcctgcttaattttatataacttcagaatgtaaagagcttcaaggtaaattacaaggtgtttaacctggggagttaaatgtgtacacttgaattaataggagcaccggttgttgctagtataaagtaatttgtgtggcagtttgtactgtgctgagtttttaaaataaacccaatattttaaa

SEQ ID NO: 300556 - DNA, 582 bp, Homo sapiens
tatctccctccactatacctattaattacaaaggggaaaacagtaactttacaagggagaaacctggcagacatcaccgtaacccagtgatgcaaaattaactgacatcattaatggatatcaaatagatatcatggtgcactgaagggacacactatccttctgtggcatctctttcaaaaccgtatgtcctgaatctgatcataaggaaaaaacccaaattgagggatattctccccacccccccaaaaaaaggcttttattctttaaaaaatgttaaggtcatgagaggcaaagaaagactgaaggactattagattacagtagactaaagagctgtgacaacaaaatgcgacatggaatcccagactggaaccttggactagcaaaaaatttcttttgaaggaaattatttggatggttggcaaaatttgaataaggcctgtagatagataggcctgtagaatagatactagttttgtatcaatgttaattttataattgttataattgttcacagccggaaaaaactatgccatgtttgtagaatccagtagggacggtttaccctcaggaggcagc

SEQ ID NO: 300557 - DNA, 5197 bp, Homo sapiens
gcgcggccttgttgggggcccccgttgcccgcctcccagtagccgcgcctcaccctaggccaggaatggttttagggaagactgttgccggatgacaaggctgtcactattgttctgtactacctgacattatgggaccaggccagccagcttcaacctgtgttcatctagcacctaggacccaacttgatgggaggagtgaccccaaagtacttcagacccagaaccagctgcagtttaataggaatgttcctacacattcaagcaacttggcgatccgatattcttgcccacatgccattagaattgaaaaactgaagcactcatacaatgaatcataccattgtaaagatgcagattgtagagttggtcctgacctgggcagttctgtttcattttccgtcatatcccaagagagacttagctatgctgtccacctagccagaagagatgtgaaacgaagacaatttgaaaaacatataaaagaacatcatctcagaagtcagcctcaaagctctcagaagtgtggacatactaagtataaaatacccgaccacagggtggaaaggaaggaatcaaagagtcaagcagcctgtcagtgtagccaccagccatccaaagtagaaatctccagctctggtgccaaagtatacctttactcatctcatccaggccagtcagatcttactgtgccaaattcgccacccacccatgatccgggacttcagcctcatcccaggataggtgaccacaaaaacataagtgaacagaaaagcctgctagaagtccagcgactccagaaagaactgagcagttgtatccacaaaattgaagaggtaactaaaaaagttcttattctacactgctgccgtagagattgctctaaaacatgaatcttaccatgtcagacctctgcttaaaagactttagtggctctctgtaacttagaggatgaaagctaaactcttcagcgtggcatgtaagacttcacgatccggcccgcctacatttccagagtcacctccaccttcactccttcatgctaaattcctattacactggggacgaagggatggaaggtgaacactgcctattcactatcttgaactggaaaccagtaactgttttttgggtgcatgaatgaagagcctttttttcattttcaagtgacttgaattaataatggttatatttggacaagaggagatatatcgatgcatccttttctacaaaaaagatcaatggaaaggtatgaagttttcttttttcccctttacaaaacaggtaaaagaaatccaggaagaattggataaattgagtccacataaaattaaacacactaagaaggtatgctgcaattaaattatgatcaatacttgcttataaatgacatttcccagtgttttgttagtattgtgtagggccctctgcactaatgttattttcagtacttgcagaaacctgttagtgagggagtgagcaccttacatattctgaatatggttgccttctaaggaacaggttctaaaaaatagatttttgttgttgttgctgctggtataaaaaattggaagtagtaaggaaaagactgccactaggaaaactttaaactttacaactccctttactatggaaaaagttttcacaataggaaaggcactttatacagaaaggagacaggctataaatattcttagaagttgggtgaatgttagcaagttctgagtatggaaataacttctctcatcttgtttattaccagtcatgggcaatgtctaagctggcggctgcccatcgaggagccattcgggccttacagatgtttgtcactcagtttactgaccgaggggagcatccacttcctgctcggtgtaaggaactgggcagccttattcgccagctttcactttgttctgtcaagctggatgcagacccttctgttcctgatgtggttatagatattctgcaacaaattgaggctttggaatctctcctggaaaagaaactgtcaccaaaaaaggtgaaaaaatgtttcagtgaaattcggagcagatttcctatcggtagccaaaaggccttggagagatggccaagtacatcaccaaagggtgagaggaggcccctcacagcaaaggacacattcccacaggaaacaagtcgaccttctgtagcaaagcagcttcttgccgataagtatcagcccgatacggagcttccggagacccagaggttgcagagtgagcttgatgtattagatgcggatatagttctggaagaaggaccatttattctagaccaaagtgcaagcttcaaagacgaggtgttagccgtggcaaaaacaaaagcagggaaaaagaagcctgtgactgagaatgtgccgtttaggaagaaagatactctggcgccagcaagacagcaaggactccgcaaagctgaaagaggtagacaaagccaacctcacagtaaaagcagagtgcagcagacaacagtttcatccagattaaaaatgaaccggcagcctgtgaaagaccgcaaggcaccatggatacccccaaaccccacatccccaccagcgtctcctaaatgtgctgcatggctaaaggtgaaaactagccccagagatgccacaaaagagcctctccagcaagaagatcctcaagaggaaagtcacctgacaggtgctgttgagcatgaagcagccaggctcgcttggcttgatgctgaaacttccaaaagattgaaggaactagaagagttaaaagccaaggaaattgacagcatgcaaaaacagaggcttgattggcttgatgctgaaacttctagaagaacaaaggaactgaatgagctcaaagctgaagaaatgtatagactccaacaattgagtgtttctgccacccacttagcagacaaggtagaggaggcagttctggatcgtttgaagcctctcttggtcaaggcccagagagtcaattctactacagaagcaaatattcatttgaaagatggctcgtcagtaaacacagcgaaagcccagcctgcacaggaggttgcagctgttgattttgaatccaacaacattcgtcagcttgatgattttttggaagattgtgccagtgagctctgggctgtgactcatgctaagatcttggggtctgaaaccttagccaccgttgaggacagcaaggatagcccagatctggagatcatgatgcgccgaatggaagagatggaaaaataccaggagtctgttcgtcaaagatataataaaatcgcatatgctgatcctcgactttggatgcaggaagaaaacaatgaccaaaaaatctcagcaataagtgaaaagcctctatctcctcatccaatcagaatcacgaagacagtggatcgcaaggatccagccgtgaacatcatgttagaaaggccctgtaatggcaattccctggatgaaagtgtgggaacagaggaaggatcagagaaaagagaggcccctcttctctccctagccgaagattctcaacagaaagaaggccgagctcccctctttgtcccaccgggtatgcagcacagcatcggtgactactgtagtcgttttgagcagtaccttcggatcatatctcatgaggctgtaggctccttcaacccgtggctgatagctgaaagcttttcagaagagctggtagatgaagctctgggtgctgtggctgctgaacttcaggatatgtgcgaagattatgcagaagctgtgttcacctcagaattcttagaggctgctacataaaggctctctgaggcgaggccgtttgtgtcacactggagaagggatggcaccaccctttgttttggcccacaggaaattttcatcctcagctgtccatccaggcccagaaggtgctgcccactgaaaggaaggcagtgccggggaggtcatcctcactttgcattttcttttgtcatggcaatggttctggaaatgtatgatgcaatgtatcacacttatcagtgcccaggcaacacaacttgattatggcaatattttcagaatgtgtacttttcctattgaaataccatgttcattcctctggctcagtttggtgatgaaaatgttttgaaagataatcgatacgtatatttcacacaaggattcaggttgctgttgaacccttgctggcattgataccaacacaagtgcggctactagctggtcccatcacggggcccctgttttgcatctttggcgatttcctgtcaggacctctggccctactaggctgtagactcagggagagcacagtctggctgtgctgccaaacctctcctctgctgcagtttattccaaacaggagccccctggctgtcagtgcacaataatagacacacatttcttcaacgttccattcctaggtgattttcacatttttagttcctcagcatattttattgctgtgtgttgacacaatctggtataaaaaactttctctggattcagaggaagtttgaggaatcaggagaggaccaggccttctcctgtgcctgggtgaaggtacagacctcgctgtgtctccgatgaggtcagaagtgtctctatttcataccacaaaggaacccaagtgggagtagggaacagatggatggcgcgaagacctctgtgtctccccagagaaaggaagaaacttaagaaccatcatagcctggtcctccaacatcttacagatcatgttttccaagagaaaagcctgtgttttcagaaactctgaattcagaaaaagaaacggaatgtgcgtaagaatcaggccactgcctggaaagactttctctcaattcgtagcctgaggctcagtgaaggaaacatgcagaaagaatgcctgagacgcccccagggaataagggaactctttataacctgtccagtgctgtcatctgggatttttctctgaagtacaagaatttcaggtgatttaagctgcttgatcacacttatttgtgcaaaattgattttcatttaatgttaatgttttcctgcttaattttatataacttcagaatgtaaagagcttcaaggtaaattacaaggtgtttaacctggggagttaaatgtgtacacttgaattaataggagcaccggttgttgctagtataaagtaatttgtgtggcagtttgtactgtgctgagtttttaaaataaacccaatattttaaa

SEQ ID NO: 300558 - DNA, 5145 bp, Homo sapiens
gcgcggccttgttgggggcccccgttgcccgcctcccagtagccgcgcctcaccctaggccaggaatggttttagggaagactgttgccggatgacaaggctgtcactattgttctgtactacctgacattatgggaccaggccagccagcttcaacctgtgttcatctagcacctaggacccaacttgatgggaggagtgaccccaaagtacttcagacccagaaccagctgcagtttaataggaatgttcctacacattcaagcaacttggcgatccgatattcttgcccacatgccattagaattgaaaaactgaagcactcatacaatgaatcataccattgtaaagatgcagattgtagagttggtcctgacctgggcagttctgtttcattttccgtcatatcccaagagagacttagctatgctgtccacctagccagaagagatgtgaaacgaagacaatttgaaaaacatataaaagaacatcatctcagaagtcagcctcaaagctctcagaagtgtggacatactaagtataaaatacccgaccacagggtggaaaggaaggaatcaaagagtcaagcagcctgtcagtgtagccaccagccatccaaagtagaaatctccagctctggtgccaaagtatacctttactcatctcatccaggccagtcagatcttactgtgccaaattcgccacccacccatgatccgggacttcagcctcatcccaggataggtgaccacaaaaacataagtgaacagaaaagcctgctagaagtccagcgactccagaaagaactgagcagttgtatccacaaaattgaagaggtaactaaaaaagttcttattctacactgctgccgtagagattgctctaaaacatgaatcttaccatgtcagacctctgcttaaaagactttagtggctctctgtaacttagaggatgaaagctaaactcttcagcgtggcatgtaagacttcacgatccggcccgcctacatttccagagtcacctccaccttcactccttcatgctaaattcctattacactggggacgaagggatggaaggtgaacactgcctattcactatcttgaactggaaaccagtaactgttttttgggtgcatgaatgaagagcctttttttcattttcaagtgacttgaattaataatggttatatttggacaagaggagatatatcgatgcatccttttctacaaaaaagatcaatggaaaggtatgaagttttcttttttcccctttacaaaacaggtaaaagaaatccaggaagaattggataaattgagtccacataaaattaaacacactaagaaggtatgctgcaattaaattatgatcaatacttgcttataaatgacatttcccagtgttttgttagtattgtgtagggccctctgcactaatgttattttcagtacttgcagaaacctgttagtgagggagtgagcaccttacatattctgaatatggttgccttctaaggaacaggttctaaaaaatagatttttgttgttgttgctgctggtataaaaaattggaagtagtaaggaaaagactgccactaggaaaactttaaactttacaactccctttactatggaaaaagttttcacaataggaaaggcactttatacagaaaggagacaggctataaatattcttagaagttgggtgaatgttagcaagttctgagtatggaaataacttctctcatcttgtttattaccagtcatgggcaatgtctaagctggcggctgcccatcgaggagccattcgggccttacagatgtttgtcactcagtttactgaccgaggggagcatccacttcctgctcggtgtaaggaactgggcagccttattcgccagctttcactttgttctgtcaagctggatgcagacccttctgttcctgatgtggttatagatattctgcaacaaattgaggctttggaatctctcctggaaaagaaactgtcaccaaaaaaggtgaaaaaatgtttcagtgaaattcggagcagatttcctatcggtagccaaaaggccttggagagatggccaagtacatcaccaaagggtgagaggaggcccctcacagcaaaggacacattcccacaggaaacaagtcgaccttctgtagcaaagcagcttcttgccgataagtatcagcccgatacggagcttccggagacccagaggttgcagagtgagcttgatgtattagatgcggatatagttctggaagaaggaccatttattctagaccaaagtgcaagcttcaaagacgaggtgttagccgtggcaaaaacaaaagcagggaaaaagaagcctgtgactgagaatgtgccgtttaggaagaaagatactctggcgccagcaagacagcaaggactccgcaaagctgaaagaggtagacaaagccaacctcacagtaaaagcagagtgcagcagacaacagtttcatccagattaaaaatgaaccggcagcctgtgaaagaccgcaaggcaccatggatacccccaaaccccacatccccaccagcgtctcctaaatgtgctgcatggctaaaggtgaaaactagccccagagatgccacaaaagagcctctccagcaagaagatcctcaagaggaaagtcacctgacaggtgctgttgagcatgaagcagccaggctcgcttggcttgatgctgaaacttccaaaagattgaaggaactagaagagttaaaagccaaggaaattgacagcatgcaaaaacagaggcttgattggcttgatgctgaaacttctagaagaacaaaggaactgaatgagctcaaagctgaagaaatgtatagactccaacaattgagtgtttctgccacccacttagcagacaaggtagaggaggcagttctggatcgtttgaagcctctcttggtcaaggcccagagagtcaattctactacagaagcaaatattcatttgaaagatggctcgtcagtaaacacagcgaaagcccagcctgcacaggaggttgcagctgttgattttgaatccaacaacattcgtcagcttgatgattttttggaagattgtgccagtgagctctgggctgtgactcatgctaagatcttggggtctgaaaccttagccaccgttgaggacagcaaggatagcccagatctggagatcatgatgcgccgaatggaagagatggaaaaataccaggagtctgttcgtcaaagatataataaaatcgcatatgctgatcctcgactttggatgcaggaagaaaacaatgaatcacgaagacagtggatcgcaaggatccagccgtgaacatcatgttagaaaggccctgtaatggcaattccctggatgaaagtgtgggaacagaggaaggatcagagaaaagagaggcccctcttctctccctagccgaagattctcaacagaaagaaggccgagctcccctctttgtcccaccgggtatgcagcacagcatcggtgactactgtagtcgttttgagcagtaccttcggatcatatctcatgaggctgtaggctccttcaacccgtggctgatagctgaaagcttttcagaagagctggtagatgaagctctgggtgctgtggctgctgaacttcaggatatgtgcgaagattatgcagaagctgtgttcacctcagaattcttagaggctgctacataaaggctctctgaggcgaggccgtttgtgtcacactggagaagggatggcaccaccctttgttttggcccacaggaaattttcatcctcagctgtccatccaggcccagaaggtgctgcccactgaaaggaaggcagtgccggggaggtcatcctcactttgcattttcttttgtcatggcaatggttctggaaatgtatgatgcaatgtatcacacttatcagtgcccaggcaacacaacttgattatggcaatattttcagaatgtgtacttttcctattgaaataccatgttcattcctctggctcagtttggtgatgaaaatgttttgaaagataatcgatacgtatatttcacacaaggattcaggttgctgttgaacccttgctggcattgataccaacacaagtgcggctactagctggtcccatcacggggcccctgttttgcatctttggcgatttcctgtcaggacctctggccctactaggctgtagactcagggagagcacagtctggctgtgctgccaaacctctcctctgctgcagtttattccaaacaggagccccctggctgtcagtgcacaataatagacacacatttcttcaacgttccattcctaggtgattttcacatttttagttcctcagcatattttattgctgtgtgttgacacaatctggtataaaaaactttctctggattcagaggaagtttgaggaatcaggagaggaccaggccttctcctgtgcctgggtgaaggtacagacctcgctgtgtctccgatgaggtcagaagtgtctctatttcataccacaaaggaacccaagtgggagtagggaacagatggatggcgcgaagacctctgtgtctccccagagaaaggaagaaacttaagaaccatcatagcctggtcctccaacatcttacagatcatgttttccaagagaaaagcctgtgttttcagaaactctgaattcagaaaaagaaacggaatgtgcgtaagaatcaggccactgcctggaaagactttctctcaattcgtagcctgaggctcagtgaaggaaacatgcagaaagaatgcctgagacgcccccagggaataagggaactctttataacctgtccagtgctgtcatctgggatttttctctgaagtacaagaatttcaggtgatttaagctgcttgatcacacttatttgtgcaaaattgattttcatttaatgttaatgttttcctgcttaattttatataacttcagaatgtaaagagcttcaaggtaaattacaaggtgtttaacctggggagttaaatgtgtacacttgaattaataggagcaccggttgttgctagtataaagtaatttgtgtggcagtttgtactgtgctgagtttttaaaataaacccaatattttaaa

SEQ ID NO: 300559 - DNA, 5378 bp, Homo sapiens
gcgcggccttgttgggggcccccgttgcccgcctcccagtagccgcgcctcaccctaggccaggaatggttttagggaagactgttgccggatgacaaggctgtcactattgttctgtactacctgacattatgggaccaggccagccagcttcaacctgtgttcatctagcacctaggacccaacttgatgggaggagtgaccccaaagtacttcagacccagaaccagctgcagtttaataggaatgttcctacacattcaagcaacttggcgatccgatattcttgcccacatgccattagaattgaaaaactgaagcactcatacaatgaatcataccattgtaaagatgcagattgtagagttggtcctgacctgggcagttctgtttcattttccgtcatatcccaagagagacttagctatgctgtccacctagccagaagagatgtgaaacgaagacaatttgaaaaacatataaaagaacatcatctcagaagtcagcctcaaagctctcagaagtgtggacatactaagtataaaatacccgaccacagggtggaaaggaaggaatcaaagagtcaagcagcctgtcagtgtagccaccagccatccaaagtagaaatctccagctctggtgccaaagtatacctttactcatctcatccaggccagtcagatcttactgtgccaaattcgccacccacccatgatccgggacttcagcctcatcccaggataggtgaccacaaaaacataagtgaacagaaaagcctgctagaagtccagcgactccagaaagaactgagcagttgtatccacaaaattgaagaggtaactaaaaaagttcttattctacactgctgccgtagagattgctctaaaacatgaatcttaccatgtcagacctctgcttaaaagactttagtggctctctgtaacttagaggatgaaagctaaactcttcagcgtggcatgtaagacttcacgatccggcccgcctacatttccagagtcacctccaccttcactccttcatgctaaattcctattacactggggacgaagggatggaaggtgaacactgcctattcactatcttgaactggaaaccagtaactgttttttgggtgcatgaatgaagagcctttttttcattttcaagtgacttgaattaataatggttatatttggacaagaggagatatatcgatgcatccttttctacaaaaaagatcaatggaaaggtatgaagttttcttttttcccctttacaaaacaggtaaaagaaatccaggaagaattggataaattgagtccacataaaattaaacacactaagaaggtatgctgcaattaaattatgatcaatacttgcttataaatgacatttcccagtgttttgttagtattgtgtagggccctctgcactaatgttattttcagtacttgcagaaacctgttagtgagggagtgagcaccttacatattctgaatatggttgccttctaaggaacaggttctaaaaaatagatttttgttgttgttgctgctggtataaaaaattggaagtagtaaggaaaagactgccactaggaaaactttaaactttacaactccctttactatggaaaaagttttcacaataggaaaggcactttatacagaaaggagacaggctataaatattcttagaagttgggtgaatgttagcaagttctgagtatggaaataacttctctcatcttgtttattaccagtcatgggcaatgtctaagctggcggctgcccatcgaggagccattcgggccttacagatgtttgtcactcagtttactgaccgaggggagcatccacttcctgctcggtgtaaggaactgggcagccttattcgccagctttcactttgttctgtcaagctggatgcagacccttctgttcctgatgtggttatagatattctgcaacaaattgaggctttggaatctctcctggaaaagaaactgtcaccaaaaaaggtgaaaaaatgtttcagtgaaattcggagcagatttcctatcggtagccaaaaggccttggagagatggccaagtacatcaccaaagggtgagaggaggcccctcacagcaaaggacacattcccacaggaaacaagtcgaccttctgtagcaaagcagcttcttgccgataagtatcagcccgatacggagcttccggagacccagaggttgcagagtgagcttgatgtattagatgcggatatagttctggaagaaggaccatttattctagaccaaagtgcaagcttcaaagacgaggtgttagccgtggcaaaaacaaaagcagggaaaaagaagcctgtgactgagaatgtgccgtttaggaagaaagatactctggcgccagcaagacagcaaggactccgcaaagctgaaagaggtagacaaagccaacctcacagtaaaagcagagtgcagcagacaacagtttcatccagattaaaaatgaaccggcagcctgtgaaagaccgcaaggcaccatggatacccccaaaccccacatccccaccagcgtctcctaaatgtgctgcatggctaaaggtgaaaactagccccagagatgccacaaaagagcctctccagcaagaagatcctcaagaggaaagtcacctgacaggtgctgttgagcatgaagcagccaggctcgcttggcttgatgctgaaacttccaaaagattgaaggaactagaagagttaaaagccaaggaaattgacagcatgcaaaaacagaggcttgattggcttgatgctgaaacttctagaagaacaaaggaactgaatgagctcaaagctgaagaaatgtatagactccaacaattgagtgtttctgccacccacttagcagacaaggtagaggaggcagttctggatcgtttgaagcctctcttggtcaaggcccagagagtcaattctactacagaagcaaatattcatttgaaagatggctcgtcagtaaacacagcgaaagcccagcctgcacaggaggttgcagctgttgattttgaatccaacaacattcgtcagcttgatgattttttggaagattgtgccagtgagctctgggctgtgactcatgctaagatcttggggtctgaaaccttagccaccgttgaggacagcaaggatagcccagatctggagatcatgatgcgccgaatggaagagatggaaaaataccaggagtctgttcgtcaaagatataataaaatcgcatatgctgatcctcgactttggatgcaggaagaaaacaatgaccaaaaaatctcagcaataagtgaaaagcctctatctcctcatccaatcagaatcacgaagacagtggatcgcaaggatccagccgtgaacatcatgttagaaaggccctgtaatggcaattccctggatgaaagtgtgggaacagaggaaggatcagagaaaagagaggcccctcttctctccctagccgaagattctcaacagaaagaaggccgagctcccctctttgtcccaccgggtatgcagcacagcatcggtgactactgtagtcgttttgagcagtaccttcggatcatatctcatgaggctgtaggctccttcaacccgtggctgatagctgaaagcttttcagaagagctggtagatgaagctctgggtgctgtggctgctgaacttcaggatatgtgcgaagattatgcagaagctgtgttcacctcagaattcttagaggctgctacataaaggctctctgaggcgaggccgtttgtgtcacactggagaagggatggcaccaccctttgttttggcccacaggaaattttcatcctcagctgtccatccaggcccagaaggtgctgcccactgaaaggaaggcagtgccggggaggtcatcctcactttgcattttcttttgtcatggcaatggttctggaaatgtatgatgcaatgtatcacacttatcagtgcccaggcaacacaacttgattatggcaatattttcagaatgtgtacttttcctattgaaataccatgttcattcctctggctcagtttggtgatgaaaatgttttgaaagataatcgatacgtatatttcacacaaggattcaggttgctgttgaacccttgctggcattgataccaacacaagtgcggctactagctggtcccatcacggggcccctgttttgcatctttggcgatttcctgtcaggacctctggccctactaggctgtagactcagggagagcacagtctggctgtgctgccaaacctctcctctgctgcagtttattccaaacaggagccccctggctgtcagtgcacaataatagacacacatttcttcaacgttccattcctaggtgattttcacatttttagttcctcagcatattttattgctgtgtgttgacacaatctggtataaaaaactttctctggattcagaggaagtttgaggaatcaggagaggaccaggccttctcctgtgcctgggtgaaggtacagacctcgctgtgtctccgatgaggtcagaagtgtctctatttcataccacaaaggaacccaagtgggagtagggaacagatggatggcgcgaagacctctgtgtctccccagagaaaggaagaaacttaagaaccatcatagcctggtcctccaacatcttacagatcatgttttccaagagaaaagcctgtgttttcagaaactctgaattcagaaaaagaaacggaatgtgcgtaagaatcaggccactgcctggaaagactttctctcaattcgtagcctgaggctcagtgaaggaaacatgcagaaagaatgcctgagacgcccccagggaataagggaactctttataacctgtccagtgctgtcatctgggatttttctctgaagtacaagaatttcaggtgatttaagctgcttgatcacacttatttgtgcaaaattgattttcatttaatgttaatgttttcctgcttaattttatataacttcagaatgtaaagagcttcaaggtaaattacaaggtgtttaacctggggagttaaatgtgtacacttgaattaataggagcaccggttgttgctagtataaagtaatttgtgtggcagtttgtactgtgctgagtttttaaaataaacccaatattttaaaaaaaaaacctattttaaataacttacatctcctttttttcccacaggcaaagtgaaatgtgatttacagaaaccactgagaatacttttatatgtgatatgactatagtggattatttgccaccccttccccccgagaaaaaaattagtgacaataaaagctaacatttattgagcaccta

SEQ ID NO: 300560 - DNA, 2495 bp, Homo sapiens
tatctccctccactatacctattaattacaaaggggaaaacagtaactttacaagggagaaacctggcagacatcaccgtaacccagtgatgcaaaattaactgacatcattaatggatatcaaatagatatcatggtgcactgaagggacacactatccttctgtggcatctctttcaaaaccgtatgtcctgaatctgatcataaggaaaaaacccaaattgagggatattctccccacccccccaaaaaaaggcttttattctttaaaaaatgttaaggtcatgagaggcaaagaaagactgaaggactattagattacagtagactaaagagctgtgacaacaaaatgcgacatggaatcccagactggaaccttggactagcaaaaaatttcttttgaaggaaattatttggatggttggcaaaatttgaataaggcctgtagatagataggcctgtagaatagatactagttttgtatcaatgttaattttataattgttataattgtaccatagttatttaagagaatgtccttgtttgtagggctacttgggagatacgaagcttgcgccgttcagaaaatgaaggtgtgtgtgtgtgtgtacagaggagcacccgtgcagagtcccctagtgtcctcccccgtctcctacagagaaggcacaccccttcctccgtcggccggtcaggcagctgttagaggtggggctaggttgcagctggttagtttctggtcgcctctggtttcaaacacattgaggatgaagtccatcctgtgtatgttttaggcctgtccctctagcaggactttgggatctaagcaccaccatccttctgtctaggagagcagggcctctcaccttgtttttcttcttcaaaatgctgggatgacaggtgtgagccaccgcgcctggccttgtacatacctttagttgtgttgtttgtcttccagcttttcagaagagctggtagatgaagctctgggtgctgtggctgctgaacttcaggatatgtgcgaagattatgcagaagctgtgttcacctcagaattcttagaggctgctacataaaggctctctgaggcgaggccgtttgtgtcacactggagaagggatggcaccaccctttgttttggcccacaggaaattttcatcctcagctgtccatccaggcccagaaggtgctgcccactgaaaggaaggcagtgccggggaggtcatcctcactttgcattttcttttgtcatggcaatggttctggaaatgtatgatgcaatgtatcacacttatcagtgcccaggcaacacaacttgattatggcaatattttcagaatgtgtacttttcctattgaaataccatgttcattcctctggctcagtttggtgatgaaaatgttttgaaagataatcgatacgtatatttcacacaaggattcaggttgctgttgaacccttgctggcattgataccaacacaagtgcggctactagctggtcccatcacggggcccctgttttgcatctttggcgatttcctgtcaggacctctggccctactaggctgtagactcagggagagcacagtctggctgtgctgccaaacctctcctctgctgcagtttattccaaacaggagccccctggctgtcagtgcacaataatagacacacatttcttcaacgttccattcctaggtgattttcacatttttagttcctcagcatattttattgctgtgtgttgacacaatctggtataaaaaactttctctggattcagaggaagtttgaggaatcaggagaggaccaggccttctcctgtgcctgggtgaaggtacagacctcgctgtgtctccgatgaggtcagaagtgtctctatttcataccacaaaggaacccaagtgggagtagggaacagatggatggcgcgaagacctctgtgtctccccagagaaaggaagaaacttaagaaccatcatagcctggtcctccaacatcttacagatcatgttttccaagagaaaagcctgtgttttcagaaactctgaattcagaaaaagaaacggaatgtgcgtaagaatcaggccactgcctggaaagactttctctcaattcgtagcctgaggctcagtgaaggaaacatgcagaaagaatgcctgagacgcccccagggaataagggaactctttataacctgtccagtgctgtcatctgggatttttctctgaagtacaagaatttcaggtgatttaagctgcttgatcacacttatttgtgcaaaattgattttcatttaatgttaatgttttcctgcttaattttatataacttcagaatgtaaagagcttcaaggtaaattacaaggtgtttaacctggggagttaaatgtgtacacttgaattaataggagcaccggttgttgctagtataaagtaatttgtgtggcagtttgtactgtgctgagtttttaaaataaacccaatattttaaa

SEQ ID NO: 300561 - DNA, 1122 bp, Homo sapiens
  misc_feature (11)..(11): n is a, c, g, or t
  misc_feature (18)..(18): n is a, c, g, or t
ctctatagatncccaccnctactggctgttttgaaagataatcgatacgtatatttcacacaaggattcaggttgctgttgaacccttgctggcattgataccaacacaagtgcggctactagctggtcccatcacggggcccctgttttgcatctttggcgatttcctgtcaggacctctggccctactaggctgtagactcagggagagcacagtctggctgtgctgccaaacctctcctctgctgcagtttattccaaacaggagccccctggctgtcagtgcacaataatagacacacatttcttcaacgttccattcctaggtgattttcacatttttagttcctcagcatattttattgctgtgtgttgacacaatctggtataaaaaactttctctggattcagaggaagtttgaggaatcaggagaggaccaggccttctcctgtgcctgggtgaaggtacagacctcgctgtgtctccgatgaggtcagaagtgtctctatttcataccacaaaggaacccaagtgggagtagggaacagatggatggcgcgaagacctctgtgtctccccagagaaaggaagaaacttaagaaccatcatagcctggtcctccaacatcttacagatcatgttttccaagagaaaagcctgtgttttcagaaactctgaattcagaaaaagaaacggaatgtgcgtaagaatcaggccactgcctggaaagactttctctcaattcgtagcctgaggctcagtgaaggaaacatgcagaaagaatgcctgagacgcccccagggaataagggaactctttataacctgtccagtgctgtcatctgggatttttctctgaagtacaagaatttcaggtgatttaagctgcttgatcacacttatttgtgcaaaattgattttcatttaatgttaatgttttcctgcttaattttatataacttcagaatgtaaagagcttcaaggtaaattacaaggtgtttaacctggggagttaaatgtgtacacttgaattaataggagcaccggttgttgctagtataaagtaatttgtgtggcagtttgtactgtgctgagtttttaaaataaacccaatattttaaa

SEQ ID NO: 300562 - DNA, 565 bp, Homo sapiens
tcttcctttctctggggagacacagagaaaggaagaaacttaagaaccatcatagcctggtcctccaacatcttacagatcatgttttccaagagaaaagcctgtgttttcagaaactctgaattcagaaaaagaaacggaatgtgcgtaagaatcaggccactgcctggaaagactttctctcaattcgtagcctgaggctcagtgaaggaaacatgcagaaagaatgcctgagacgcccccagggaataagggaactctttataacctgtccagtgctgtcatctgggatttttctctgaagtacaagaatttcaggtgatttaagctgcttgatcacacttatttgtgcaaaattgattttcatttaatgttaatgttttcctgcttaattttatataacttcagaatgtaaagagcttcaaggtaaattacaaggtgtttaacctggggagttaaatgtgtacacttgaattaataggagcaccggttgttgctagtataaagtaatttgtgtggcagtttgtactgtgctgagtttttaaaataaacccaatattttaaa

SEQ ID NO: 300563 - DNA, 357 bp, Homo sapiens
tctgtcaagctggatgcagacccttctgttcctgatgtggttatagatattctgcaacaaattgaggtatggaattaattccaatttttgttagaggtgcattggaagtaatgcttactattacctagtttcgttaggatttatggagaatacaagacaaagccattacctagtgaattaaagctttgcagagggcagaagaaacacttctttttgttttgctatttttacagtgtagtctgtattatcgtatttcactgcttcgaaaattggtaacttgaatataaaacatgtaacaactttaaaccaggttcattaactaaacagaatgtcccattccctggcccatgccatttg

SEQ ID NO: 300564 - DNA, 431 bp, Homo sapiens
ggaaaggtatgaagttttcttttttcccctttacaaaacaggtaaaagaaatccaggaagaattggataaattgagtccacataaaattaaacacactaagaaggtatgctgcaattaaattatgatcaatacttgcttataaatgacatttcccagtgttttgttagtattgtgtagggccctctgcactaatgttattttcagtacttgcagaaacctgttagtgagggagtgagcaccttacatattctgaatatggttgccttctaaggaacaggttctaaaaaatagatttttgttgttgttgctgctggtataaaaaattggaagtagtaaggaaaagactgccactaggaaaactttaaactttacaactccctttactatggaaaaagttttcacaataggaaaggcactttatacagaaagg

SEQ ID NO: 300565 - DNA, 431 bp, Homo sapiens
gaatggttttagggaagactgttgccggatgacaaggctgtcactattgttctgtactacctgacattatgggaccaggccagccagcttcaacctgtgttcatctagcacctaggacccaacttgatgggaggagtgaccccaaagtacttcagacccaggtagttctatttttgcctgagatttttattattaaatatttcaaacataaaatttgaaagaaaaggacagtgaacacttttgaaatcacctcctagattcagcaattgctaacaattttttctgtttttctacctactcaaccatctgtctttaaaatttttgcagaatcaccccaaagcaaattgcagtcaacctgatacttctaaatatttgagaatacttctcctaaaaatgaactctcctacttaatcatgatactattcttatac

SEQ ID NO: 300566 - DNA, 792 bp, Homo sapiens
tttctcttgtttgaaaaagtcctaagtgtatgggaagtggctatggtgccctctcactctgcccctcccgtgtgcttgtgctctgcaggtatggatttaacagtcacgggctttcagtggtggaacacaggttacgggccagacagcagaagcaggccaagctcacagaaggtaaagtggggttgtgtcagtgggcctttcttatttattaggaggaaacgtgggagaaatgctgggaacatttctagtgaaataaacatgattgagcaatagcaaaaaccactgaggacctcaggacacctctcctagagcgattttcctggtcccacacagcttccaagagtttaactggattttgcaatttagcaaatactcactttgcctctgccttgttatgtaacctgttaccgtaactagggaggcctgaaagcaagcgaagcaaagcggctgggcaatgatcacacaggcaatgagggcaggagcaggacttgaatgtcatcctcccgtggcccactctgtcctcccttttttgtcatccattgtgtaaataatgttcattaattatagaagacttagtaaatacagagaagcgtaaagaaagaatgttcaagaaacagatactcctccctactcaaggctaactaatattagcatttgggaaaatattcttcatgagttgttttggaaactcatttttggttcgggacagttcacacctgtaatctcaatactttgggtgcccaagttgggaggatcacttgaactcaggagtttaagaccagcctgggcaac

SEQ ID NO: 300567 - DNA, 1515 bp, Homo sapiens
gggcttaatgacggaaggagcatggcgtggagacacctgcaaaagcgggcccaggatgctgtgatcatcctggggggaggaggacttctcttcgcctcctacctgatggccacgggagatgagcgtttctatgctgaacacctgatgccgactctgcaggggctgctggacccggagtcagcccacagactggctgttcgcttcacctccctggggctccttccacgggccagatttcaagactctgacatgctggaagtgagagttctgggccataaattccgaaatccagtaggaattgctgcaggatttgacaagcatggggaagccgtggacggactttataagatgggctttggttttgttgagataggaagtgtgactccaaaacctcaggaaggaaaccctagacccagagtcttccgcctccctgaggaccaagctgtcattaacaggtatggatttaacagtcacgggctttcagtggtggaacacaggttacgggccagacagcagaagcaggccaagctcacagaagatggactgcctctgggggtcaacttggggaagaacaagacctcagtggacgccgcggaggactacgcagaaggggtgcgcgtactgggccccctggccgactacctggtggtgaatgtgtccagccccaacactgccgggctgcggagccttcagggaaaggccgagctgcgccgcctgctgaccaaggtgctgcaggagagggatggcttgcggagagtgcacaggccggcagtcctggtgaagatcgctcctgacctcaccagccaggataaggaggacattgccagtgtggtcaaagagttgggcatcgatgggctgattgttacgaacaccaccgtgagtcgccctgcgggcctccagggtgccctgcgctctgaaacaggagggctgagtgggaagcccctccgggatttatcaactcaaaccattcgggagatgtatgcactcacccaaggccgagttcccataattggggttggtggtgtgagcagcgggcaggacgcgctggagaagatccgggcaggggcctccctggtgcagctgtacacggccctcaccttctgggggccacccgttgtgggcaaagtcaagcgggaactggaggcccttctgaaagagcagggctttggcggagtcacagatgccattggagcagatcatcggaggtgaggacagcgtctgacgggaagcctgatctggaaccttcccaaggactcaggcaagcctttgtggctggatcatgagaggagggactccatcttgagccatgtcccccagccatggcatggctgcactgtaaacgccaatcggggggtcaccaggatcaaccgcaggctttcttcagtcccttggtcagaccataaactgcatttttgattctttgtggattcaaaccctaggatccatcagtcttgcaaggacattgaatattaggaggaaaaagtcatggaaaaaataaagccatttagaacctgg

SEQ ID NO: 300568 - DNA, 2439 bp, Homo sapiens
gggcttaatgacggaaggagcatggcgtggagacacctgcaaaagcgggcccaggatgctgtgatcatcctggggggaggaggacttctcttcgcctcctacctgatggccacgggagatgagcgtttctatgctgaacacctgatgccgactctgcaggggctgctggacccggagtcagcccacagactggctgttcgcttcacctccctggggctccttccacgggccagatttcaagactctgacatgctggaagtgagagttctgggccataaattccgaaatccagtaggaattgctgcaggatttgacaagcatggggaagccgtggacggactttataagatgggctttggttttgttgagataggaagtgtgactccaaaacctcaggaaggaaaccctagacccagagtcttccgcctccctgaggaccaagctgtcattaacaggtatggatttaacagtcacgggctttcagtggtggaacacaggttacgggccagacagcagaagcaggccaagctcacagaagatggactgcctctgggggtcaacttggggaagaacaagacctcagtggacgccgcggaggactacgcagaaggggtgcgcgtactgggccccctggccgactacctggtggtgaatgtgtccagccccaacactgccgggctgcggagccttcagggaaaggccgagctgcgccgcctgctgaccaaggtgctgcaggagagggatggcttgcggagagtgcacaggccggcagtcctggtgaagatcgctcctgacctcaccagccaggataaggaggacattgccagtgtggtcaaagagttgggcatcgatgggctgattgttacgaacaccaccgtgagtcgccctgcgggcctccagggtgccctgcgctctgaaacaggagggctgagtgggaagcccctccgggatttatcaactcaaaccattcgggagatgtatgcactcacccaaggccgagttcccataattggggttggtggtgtgagcagcgggcaggacgcgctggagaagatccgggcaggggcctccctggtgcagctgtacacggccctcaccttctgggggccacccgttgtgggcaaagtcaagcgggaactggaggcccttctgaaagagcagggctttggcggagtcacagatgccattggagcagatcatcggaggtgaggacagcgtctgacgggaagcctgatctggaaccttcccaaggactcaggcaagcctttgtggctggatcatgagaggagggactccatcttgagccatgtcccccagccatggcatggctgcactgtaaacgccaatcggggggtcaccaggatcaaccgcaggctttcttcagtcccttggtcagaccataaactgcatttttgattctttgtggattcaaaccctaggatccatcagtcttgcaaggacattgaatattaggaggaaaaagtcatggaaaaaataaagccatttagaacctgggtttcaacgctagccctttctggtttgccataggccctgccaagatactgcaggtccatccaggcctctgctatctgcatctgcagtgggcttcccaggaacttgactgtctttcatttgatctttatttttgtttatttaatattttaaactttattttaaaaatatttcaaacataagggcggggtgtggtggctcatgcctgtaatcccagcactttgggaggccgaggcgggcggatcacctgaggccaggagttggagaccagccaggccaccatggtgaaaccctgtctctaccaaaaatacaaaaaattagccagatattgtggcaggcacttttaatcccagctactcgggaggctgaggcaggagaattgcttgaacctgggaggcggaggttgcagtgagccaagattgcaccagtgcactccagcttgggcgacagatcaagactctgtcacacacaaaacaaacaaacaaattttcccgtttctctctgtccctttctctataacatggataaaatattcacgtcttatgtatttattattgctgagtcattggtgccttattcttcagtgtttcagtctgtatctcctaagcatcctgatgttagttttttgactataaaattgacctgcattctttactagcaattcaaacggtacagcactcttgaagtgtaaacattcctgttcctcctcaccccactctgcagacatgcctttctgtctgtcctcccagacttttcccctgcataaagatgttcattttgtacatacactcagacatacatgtggctgtattttttgtataccgatttctggatggaatgcacactgttatctgtttagttactttatgttttcatacaaatgacatcatcccacaaatagaattctgccatttactttcttcacta

SEQ ID NO: 300569 - DNA, 2726 bp, Homo sapiens
accagggaccggggagggcgagaacggagagtcaggccgggcgaggcatggaccgaaggcggctccgggagtgtgggcccccctgggacgtgtgcgtgtttccggggtctcctgcaaatgctcgtgcgtgtgcatttgcacgtggactcggtcaggcgtgtgcagacagcgcctgcaggtctgggtgggtgctgatctgagtgtctgcgcctgggccatgtttttgagcctggcacaggggtgcttagtgaacacatgaccgcctagcgttgtgtgccggatccaacggggaatgaaactagagtaggacatgctcccaacccttttagaagcgggcccaggatgctgtgatcatcctggggggaggaggacttctcttcgcctcctacctgatggccacgggagatgagcgtttctatgctgaacacctgatgccgactctgcaggggctgctggacccggagtcagcccacagactggctgttcgcttcacctccctggggctccttccacgggccagatttcaagactctgacatgctggaagtgagagttctgggccataaattccgaaatccagtaggaattgctgcaggatttgacaagcatggggaagccgtggacggactttataagatgggctttggttttgttgagataggaagtgtgactccaaaacctcaggaaggaaaccctagacccagagtcttccgcctccctgaggaccaagctgtcattaacaggtatggatttaacagtcacgggctttcagtggtggaacacaggttacgggccagacagcagaagcaggccaagctcacagaagatggactgcctctgggggtcaacttggggaagaacaagacctcagtggacgccgcggaggactacgcagaaggggtgcgcgtactgggccccctggccgactacctggtggtgaatgtgtccagccccaacactgccgggctgcggagccttcagggaaaggccgagctgcgccgcctgctgaccaaggtgctgcaggagagggatggcttgcggagagtgcacaggccggcagtcctggtgaagatcgctcctgacctcaccagccaggataaggaggacattgccagtgtggtcaaagagttgggcatcgatgggctgattgttacgaacaccaccgtgagtcgccctgcgggcctccagggtgccctgcgctctgaaacaggagggctgagtgggaagcccctccgggatttatcaactcaaaccattcgggagatgtatgcactcacccaaggccgagttcccataattggggttggtggtgtgagcagcgggcaggacgcgctggagaagatccgggcaggggcctccctggtgcagctgtacacggccctcaccttctgggggccacccgttgtgggcaaagtcaagcgggaactggaggcccttctgaaagagcagggctttggcggagtcacagatgccattggagcagatcatcggaggtgaggacagcgtctgacgggaagcctgatctggaaccttcccaaggactcaggcaagcctttgtggctggatcatgagaggagggactccatcttgagccatgtcccccagccatggcatggctgcactgtaaacgccaatcggggggtcaccaggatcaaccgcaggctttcttcagtcccttggtcagaccataaactgcatttttgattctttgtggattcaaaccctaggatccatcagtcttgcaaggacattgaatattaggaggaaaaagtcatggaaaaaataaagccatttagaacctgggtttcaacgctagccctttctggtttgccataggccctgccaagatactgcaggtccatccaggcctctgctatctgcatctgcagtgggcttcccaggaacttgactgtctttcatttgatctttatttttgtttatttaatattttaaactttattttaaaaatatttcaaacataagggcggggtgtggtggctcatgcctgtaatcccagcactttgggaggccgaggcgggcggatcacctgaggccaggagttggagaccagccaggccaccatggtgaaaccctgtctctaccaaaaatacaaaaaattagccagatattgtggcaggcacttttaatcccagctactcgggaggctgaggcaggagaattgcttgaacctgggaggcggaggttgcagtgagccaagattgcaccagtgcactccagcttgggcgacagatcaagactctgtcacacacaaaacaaacaaacaaattttcccgtttctctctgtccctttctctataacatggataaaatattcacgtcttatgtatttattattgctgagtcattggtgccttattcttcagtgtttcagtctgtatctcctaagcatcctgatgttagttttttgactataaaattgacctgcattctttactagcaattcaaacggtacagcactcttgaagtgtaaacattcctgttcctcctcaccccactctgcagacatgcctttctgtctgtcctcccagacttttcccctgcataaagatgttcattttgtacatacactcagacatacatgtggctgtattttttgtataccgatttctggatggaatgcacactgttatctgtttagttactttatgttttcatacaaatgacatcatcccacaaatagaattctgccatttactttcttcacta

SEQ ID NO: 300570 - DNA, 2581 bp, Homo sapiens
accagggaccggggagggcgagaacggagagtcaggccgggcgaggcatggaccgaaggcggctccgggagtgtgggcccccctgggacgtgtgcgtgtttccggggtctcctgcaaatgctcgtgcgtgtgcatttgcacgtggactcggtcaggcgtgtgcagacagcgcctgcaggtctggaagcgggcccaggatgctgtgatcatcctggggggaggaggacttctcttcgcctcctacctgatggccacgggagatgagcgtttctatgctgaacacctgatgccgactctgcaggggctgctggacccggagtcagcccacagactggctgttcgcttcacctccctggggctccttccacgggccagatttcaagactctgacatgctggaagtgagagttctgggccataaattccgaaatccagtaggaattgctgcaggatttgacaagcatggggaagccgtggacggactttataagatgggctttggttttgttgagataggaagtgtgactccaaaacctcaggaaggaaaccctagacccagagtcttccgcctccctgaggaccaagctgtcattaacaggtatggatttaacagtcacgggctttcagtggtggaacacaggttacgggccagacagcagaagcaggccaagctcacagaagatggactgcctctgggggtcaacttggggaagaacaagacctcagtggacgccgcggaggactacgcagaaggggtgcgcgtactgggccccctggccgactacctggtggtgaatgtgtccagccccaacactgccgggctgcggagccttcagggaaaggccgagctgcgccgcctgctgaccaaggtgctgcaggagagggatggcttgcggagagtgcacaggccggcagtcctggtgaagatcgctcctgacctcaccagccaggataaggaggacattgccagtgtggtcaaagagttgggcatcgatgggctgattgttacgaacaccaccgtgagtcgccctgcgggcctccagggtgccctgcgctctgaaacaggagggctgagtgggaagcccctccgggatttatcaactcaaaccattcgggagatgtatgcactcacccaaggccgagttcccataattggggttggtggtgtgagcagcgggcaggacgcgctggagaagatccgggcaggggcctccctggtgcagctgtacacggccctcaccttctgggggccacccgttgtgggcaaagtcaagcgggaactggaggcccttctgaaagagcagggctttggcggagtcacagatgccattggagcagatcatcggaggtgaggacagcgtctgacgggaagcctgatctggaaccttcccaaggactcaggcaagcctttgtggctggatcatgagaggagggactccatcttgagccatgtcccccagccatggcatggctgcactgtaaacgccaatcggggggtcaccaggatcaaccgcaggctttcttcagtcccttggtcagaccataaactgcatttttgattctttgtggattcaaaccctaggatccatcagtcttgcaaggacattgaatattaggaggaaaaagtcatggaaaaaataaagccatttagaacctgggtttcaacgctagccctttctggtttgccataggccctgccaagatactgcaggtccatccaggcctctgctatctgcatctgcagtgggcttcccaggaacttgactgtctttcatttgatctttatttttgtttatttaatattttaaactttattttaaaaatatttcaaacataagggcggggtgtggtggctcatgcctgtaatcccagcactttgggaggccgaggcgggcggatcacctgaggccaggagttggagaccagccaggccaccatggtgaaaccctgtctctaccaaaaatacaaaaaattagccagatattgtggcaggcacttttaatcccagctactcgggaggctgaggcaggagaattgcttgaacctgggaggcggaggttgcagtgagccaagattgcaccagtgcactccagcttgggcgacagatcaagactctgtcacacacaaaacaaacaaacaaattttcccgtttctctctgtccctttctctataacatggataaaatattcacgtcttatgtatttattattgctgagtcattggtgccttattcttcagtgtttcagtctgtatctcctaagcatcctgatgttagttttttgactataaaattgacctgcattctttactagcaattcaaacggtacagcactcttgaagtgtaaacattcctgttcctcctcaccccactctgcagacatgcctttctgtctgtcctcccagacttttcccctgcataaagatgttcattttgtacatacactcagacatacatgtggctgtattttttgtataccgatttctggatggaatgcacactgttatctgtttagttactttatgttttcatacaaatgacatcatcccacaaatagaattctgccatttactttcttcacta

SEQ ID NO: 300571 - DNA, 2682 bp, Homo sapiens
accagggaccggggagggcgagaacggagagtcaggccgggcgaggcatggaccgaaggcggctccgggagtgtgggcccccctgggacgtgtgcgtgtttccggggtctcctgcaaatgctcgtgcgtgtgcatttgcacgtggactcggtcaggcgtgtgcagacagcgcctgcaggtctggaagcgggcccaggatgctgtgatcatcctggggggaggaggacttctcttcgcctcctacctgatggccacgggagatgagcgtttctatgctgaacacctgatgccgactctgcaggggctgctggacccggagtcagcccacagactggctgttcgcttcacctccctggggctccttccacgggccagatttcaagactctgacatgctggtagtgctcccagacaccctatacattaaatacaaaggcgaaggctgcagtcccctaaacttctcagctgggactgatctttttgaaaaccagaaccccaagaagtgagagttctgggccataaattccgaaatccagtaggaattgctgcaggatttgacaagcatggggaagccgtggacggactttataagatgggctttggttttgttgagataggaagtgtgactccaaaacctcaggaaggaaaccctagacccagagtcttccgcctccctgaggaccaagctgtcattaacaggtatggatttaacagtcacgggctttcagtggtggaacacaggttacgggccagacagcagaagcaggccaagctcacagaagatggactgcctctgggggtcaacttggggaagaacaagacctcagtggacgccgcggaggactacgcagaaggggtgcgcgtactgggccccctggccgactacctggtggtgaatgtgtccagccccaacactgccgggctgcggagccttcagggaaaggccgagctgcgccgcctgctgaccaaggtgctgcaggagagggatggcttgcggagagtgcacaggccggcagtcctggtgaagatcgctcctgacctcaccagccaggataaggaggacattgccagtgtggtcaaagagttgggcatcgatgggctgattgttacgaacaccaccgtgagtcgccctgcgggcctccagggtgccctgcgctctgaaacaggagggctgagtgggaagcccctccgggatttatcaactcaaaccattcgggagatgtatgcactcacccaaggccgagttcccataattggggttggtggtgtgagcagcgggcaggacgcgctggagaagatccgggcaggggcctccctggtgcagctgtacacggccctcaccttctgggggccacccgttgtgggcaaagtcaagcgggaactggaggcccttctgaaagagcagggctttggcggagtcacagatgccattggagcagatcatcggaggtgaggacagcgtctgacgggaagcctgatctggaaccttcccaaggactcaggcaagcctttgtggctggatcatgagaggagggactccatcttgagccatgtcccccagccatggcatggctgcactgtaaacgccaatcggggggtcaccaggatcaaccgcaggctttcttcagtcccttggtcagaccataaactgcatttttgattctttgtggattcaaaccctaggatccatcagtcttgcaaggacattgaatattaggaggaaaaagtcatggaaaaaataaagccatttagaacctgggtttcaacgctagccctttctggtttgccataggccctgccaagatactgcaggtccatccaggcctctgctatctgcatctgcagtgggcttcccaggaacttgactgtctttcatttgatctttatttttgtttatttaatattttaaactttattttaaaaatatttcaaacataagggcggggtgtggtggctcatgcctgtaatcccagcactttgggaggccgaggcgggcggatcacctgaggccaggagttggagaccagccaggccaccatggtgaaaccctgtctctaccaaaaatacaaaaaattagccagatattgtggcaggcacttttaatcccagctactcgggaggctgaggcaggagaattgcttgaacctgggaggcggaggttgcagtgagccaagattgcaccagtgcactccagcttgggcgacagatcaagactctgtcacacacaaaacaaacaaacaaattttcccgtttctctctgtccctttctctataacatggataaaatattcacgtcttatgtatttattattgctgagtcattggtgccttattcttcagtgtttcagtctgtatctcctaagcatcctgatgttagttttttgactataaaattgacctgcattctttactagcaattcaaacggtacagcactcttgaagtgtaaacattcctgttcctcctcaccccactctgcagacatgcctttctgtctgtcctcccagacttttcccctgcataaagatgttcattttgtacatacactcagacatacatgtggctgtattttttgtataccgatttctggatggaatgcacactgttatctgtttagttactttatgttttcatacaaatgacatcatcccacaaatagaattctgccatttactttcttcacta

SEQ ID NO: 300572 - DNA, 2614 bp, Homo sapiens
gggcttaatgacggaaggagcatggcgtggagacacctgcaaaagcgggcccaggatgctgtgatcatcctggggggaggaggacttctcttcgcctcctacctgatggccacgggagatgagcgtttctatgctgaacacctgatgccgactctgcaggggctgctggacccggagtcagcccacagactggctgttcgcttcacctccctggggctccttccacgggccagatttcaagactctgacatgctggaagtgagagttctgggccataaattccgaaatccagtaggaattgctgcaggatttgacaagcatggggaagccgtggacggactttataagatgggctttggttttgttgagataggaagtgtgactccaaaacctcaggaaggaaaccctagacccagagtcttccgcctccctgaggaccaagctgtcattaacaggtggggatcaatatcttcagaattggccaggcaaaatatatttgcttaacattcagctgctacagataactgcaggtgctgggatgatggtacttggtgaatcctataggtgagcaggggtgtgagatcctgctctgagccctgtgtgtgcggcctcctggttgtgtggcatgtggtatggatttaacagtcacgggctttcagtggtggaacacaggttacgggccagacagcagaagcaggccaagctcacagaagatggactgcctctgggggtcaacttggggaagaacaagacctcagtggacgccgcggaggactacgcagaaggggtgcgcgtactgggccccctggccgactacctggtggtgaatgtgtccagccccaacactgccgggctgcggagccttcagggaaaggccgagctgcgccgcctgctgaccaaggtgctgcaggagagggatggcttgcggagagtgcacaggccggcagtcctggtgaagatcgctcctgacctcaccagccaggataaggaggacattgccagtgtggtcaaagagttgggcatcgatgggctgattgttacgaacaccaccgtgagtcgccctgcgggcctccagggtgccctgcgctctgaaacaggagggctgagtgggaagcccctccgggatttatcaactcaaaccattcgggagatgtatgcactcacccaaggccgagttcccataattggggttggtggtgtgagcagcgggcaggacgcgctggagaagatccgggcaggggcctccctggtgcagctgtacacggccctcaccttctgggggccacccgttgtgggcaaagtcaagcgggaactggaggcccttctgaaagagcagggctttggcggagtcacagatgccattggagcagatcatcggaggtgaggacagcgtctgacgggaagcctgatctggaaccttcccaaggactcaggcaagcctttgtggctggatcatgagaggagggactccatcttgagccatgtcccccagccatggcatggctgcactgtaaacgccaatcggggggtcaccaggatcaaccgcaggctttcttcagtcccttggtcagaccataaactgcatttttgattctttgtggattcaaaccctaggatccatcagtcttgcaaggacattgaatattaggaggaaaaagtcatggaaaaaataaagccatttagaacctgggtttcaacgctagccctttctggtttgccataggccctgccaagatactgcaggtccatccaggcctctgctatctgcatctgcagtgggcttcccaggaacttgactgtctttcatttgatctttatttttgtttatttaatattttaaactttattttaaaaatatttcaaacataagggcggggtgtggtggctcatgcctgtaatcccagcactttgggaggccgaggcgggcggatcacctgaggccaggagttggagaccagccaggccaccatggtgaaaccctgtctctaccaaaaatacaaaaaattagccagatattgtggcaggcacttttaatcccagctactcgggaggctgaggcaggagaattgcttgaacctgggaggcggaggttgcagtgagccaagattgcaccagtgcactccagcttgggcgacagatcaagactctgtcacacacaaaacaaacaaacaaattttcccgtttctctctgtccctttctctataacatggataaaatattcacgtcttatgtatttattattgctgagtcattggtgccttattcttcagtgtttcagtctgtatctcctaagcatcctgatgttagttttttgactataaaattgacctgcattctttactagcaattcaaacggtacagcactcttgaagtgtaaacattcctgttcctcctcaccccactctgcagacatgcctttctgtctgtcctcccagacttttcccctgcataaagatgttcattttgtacatacactcagacatacatgtggctgtattttttgtataccgatttctggatggaatgcacactgttatctgtttagttactttatgttttcatacaaatgacatcatcccacaaatagaattctgccatttactttcttcacta

SEQ ID NO: 300573 - DNA, 958 bp, Homo sapiens
gggcttaatgacggaaggagcatggcgtggagacacctgcaaaagcgggcccaggatgctgtgatcatcctggggggaggaggacttctcttcgcctcctacctgatggccacgggagatgagcgtttctatgctgaacacctgatgccgactctgcaggggctgctggacccggagtcagcccacagactggctgttcgcttcacctccctggggctccttccacgggccagatttcaagactctgacatgctggaagtgagagttctgggccataaattccgaaatccagtaggaattgctgcaggatttgacaagcatggggaagccgtggacggactttataagatgggctttggttttgttgagataggaagtgtgactccaaaacctcaggaaggaaaccctagacccagagtcttccgcctccctgaggaccaagctgtcattaacaggtatggatttaacagtcacgggctttcagtggtggaacacaggttacgggccagacagcagaagcaggccaagctcacagaagatggactgcctctgggggtcaacttggggaagaacaagacctcagtggacgccgcggaggactacgcagaaggggtgcgcgtactgggccccctggccgactacctggtggtgaatgtgtccagccccaacactgccgggctgcggagccttcagggaaaggccgagctgcgccgcctgctgaccaaggtgctgcaggagagggatggcttgcggagagtgcacaggccggcagtcctggtgaagatcgctcctgacctcaccagccaggataaggaggacattgccagtgtggtcaaagagttgggcatcgatgggctgattgttacgcacacacacacacaattttaacttgtttttttgtacataatgtacatactgtcaattttttattaaaagaaatatgctttgatgtgctagc

SEQ ID NO: 300574 - DNA, 366 bp, Homo sapiens
tgaacacatgaccgcctagcgttgtgtgccggatccaacggggaatgaaactagagtaggacatgctcccaacccttttaggtaaagttttgttaggggcgggggtctctgtgaaaagttcttagctgtatccccgtatgtaataggtgttcagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaa

SEQ ID NO: 300575 - DNA, 450 bp, Homo sapiens
  misc_feature (82)..(82): n is a, c, g, or t
aaccccagagcgggatactcgggatctgagcagaggggaaagtcatctaagaggctgctgctttacaaggtctgggcacagngctgcccctcccttcctccctgaagtttgcatgaagtgcacattaggctgtaattaggggatttgggaggagaactttcctggtgacgctttgcttttcttctgctcttggtgagaaagtgcctccttcttcccaggatcaggacctctgccatccagcgccacaaagagacattctgcacacacactcacacacacacacacacacacactctcacactcgcccagagacaaacttaaggtgaggagaaagagcgctagcttcacttgatctccagcttccaacttaagcagaacttgagagcatccgaactcctggatttcaggacaaggtaaaacttgcaaattgtttccccctcttttggttat

SEQ ID NO: 300576 - DNA, 4882 bp, Homo sapiens
  misc_feature (82)..(82): n is a, c, g, or t
aaccccagagcgggatactcgggatctgagcagaggggaaagtcatctaagaggctgctgctttacaaggtctgggcacagngctgcccctcccttcctccctgaagtttgcatgaagtgcacattaggctgtaattaggggatttgggaggagaactttcctggtgacgctttgcttttcttctgctcttggtgagaaagtgcctccttcttcccaggatcaggacctctgccatccagcgccacaaagagacattctgcacacacactcacacacacacacacacacacactctcacactcgcccagagacaaacttaaggtgaggagaaagagcgctagcttcacttgatctccagcttccaacttaagcagaacttgagagcatccgaactcctggatttcaggacaagtgaagaagattctttgggctataaagatgaagagtctacttcttctggtgctgatttcaatctgctgggctgatcatctttcagacaactatactctggatcatgacagagctattcacatccaagcagaaaatggcccccatctacttgtggaagcagagcaagccaaggtgttttcacacagaggtggcaatgttacactgccatgtaaattttatcgagaccctacagcatttggctcaggaatccataaaatccgaattaagtggaccaagctaacttcggattacctcaaggaagtggatgtttttgtttccatgggataccacaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggtgtggtattcccttactttccacgactggggcgctacaatctcaattttcacgaggcgcagcaggcgtgtctggaccaggatgctgtgatcgcctccttcgaccagctgtacgacgcctggcggggcgggctggactggtgcaatgccggctggctcagtgatggctctgtgcaatatcccatcacaaagcccagagagccctgtgggggccagaacacagtgcccggagtcaggaactacggattttgggataaagataaaagcagatatgatgttttctgttttacatccaatttcaatggccgtttttactatctgatccaccccaccaaactgacctatgatgaagcggtgcaagcttgtctcaatgatggtgctcagattgcaaaagtgggccagatatttgctgcctggaaaattctcggatatgaccgctgtgatgcgggctggttggcggatggcagcgtccgctaccccatctctaggccaagaaggcgctgcagtcctactgaggctgcagtgcgcttcgtgggtttcccagataaaaagcataagctgtatggtgtctactgcttcagagcatacaactgaatgtgcccttagagcgcatcagttttaaagtcattaagaacatgtgaaaggtgttttttttttccaatatgaactcatgcaagttaccaaaactgtgataacccttttttacttactgtaaagagtcattttcataaagatcaattcattgatttgttttttgtaaagctatcattcaatatatattataaattaatataaatttaagggaagctctatgtaaggagacttagagccaaactgtttaagctgtatcatcccaacaaagtatcctttcatgaacggggcatgcaatagcttaagaattgctaggattaaattaaggaaagtaaagctactcagagcagcaggttccacaagcacaaactttacacatttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaataggcagaatattttactctttaaaatcctgcctttctgaccaaaaaaaaaaaaaaaaattcatatggattccaatccatagttaacaagcacagttaaaactcctcaataatcccatttatatgaagcatgacacataaataagcagataatatttaaccaatgaaaaagacttctaccttcttataattaaaattacacatgtctaagaggaattgttttatcttttgagtagctttaccgagttgtatttaaattctaagggccatttgctaagcagcatttagcatctactcagggcagttatatagataaactgctggacagaaaaattgtaaaatttagcagcttgattttctgttagcctatgaaatgttattgtcctataaaaataactttaaactgatttaatatttcatatttacattatatgaaaatcaattacattataaaaggaatccctaatgcagaaacaaagatgcaactttcaaaattcttattattcctatttgtatatacacgagagaacccaaccagtgcctgtgtttggggggaaaagtcaacagtgtagttctaaaccttatcccaaacagaaaatgtggttaatgatgtcactttccttgctggtcatcattaggcttaaattaaatgctgaagctgtcatcaaagagtttacactaaaatcttcagggctttaaataaaaggttaagtccagcttccaaacacaattttccacattagcagctccaatcttcttaaataaagctctgttttcctatatttttatgactgctgagaccccacagggaccaatatttgtattcaaattacatttcatggtttcccattgtttcacaatgagttctaataaatgggatttactataataatccaagtatgacatagccggtatgctttcatgaatgtttttatgtagattttcctcccatgaacatgagtaaataaatctgtttcctgaatggattgtggttgcatttaaagctctgtaataattctaataaatttactctatagagttctgtgtgtggaaggtatagaacaattggaagtccatgaaaccataactataatcatatattattcagacaaaatattgtaataaaagtaggtcctttctttcatcaaaaacatatctgaaaattttcagatgctttaatattaaaagatgacaatgttatgtatgcacatttttaagttaggttggatatgcaaactgtacaaaactataaatccaaagagtttgtaaagtttaaactcaaacactggtggtataaatagaacttgcacttctaaattaaggaagatacctaaatggtctaggatgagatgatatattatttaaagaggggactatctcccaaataacaactttaacacctcaaatatgggggctagctcattgaaagaagtccatacttgaactattattatgtatgttccgataattttgttgaaaatacaagtgggaacaaatttctattgaagcaaacatctaattttcagttatgtccagaactctactttataatgttaaatgtagtagtatttcttaacttttaaatacttactactataggaatggtgctgatcaaaatctctggagtgactgttagctgattaaaatctataccacttacacatcatttttccattcgtgtaaaaaacaaaaaatcttaacacagtgaatactgctgagcagaattttttcttctcattttgctcaaaggaccagaatttccatgccctttatactcatacttgaatgagtctttttaatgttctcattttgctgtttttccaccaaatgtctattttcctacttcattccccaagatgtctcactgagcaggtctgaaaaagaaaggttattctaatacaattcctaacagaaagttggtacaacactggctaattcagaaatcgctcctcagacttagattccaagagtatcaaagagattagatgggaggctgggccaggaacccttgttttaatgtatttgtccataattaacactggtgaccatataaggaacaaagtatatctgcacatttcactgagacatctacattggaaaacccaaacaaaaagaagcaattcaaataaaaagacaacataagaacgaaaataagttggtcacattaacactggaagccatctttaagtgagtgctgtcatattgtgtcacagtaatttttagccaaatatggcgtttgtaaatttaaactttctctcatggaaagggggctggtacctgtcaaagtgttattttatgcaacaatatagtcactttttattttggcaattagaagtagactcaaaggagattacaatttggttgctggcagccattctgggtttcttgattttagtactccaaagaatatggtggtctcatggagtagctgaccactaaggaggggaggattaaaagggaatcacttatcagtttttagcataggatgcattaagaaatatcaacggataactgacatcgttttgttaagaagttaactgtatcatagctcactactgccagagcggcaatggatgtacaacgaaagagatgaaaaatacaaaagttattaagccacctgattaaaagaaaaccaatatttaaaggcatttaatagatatcaagtataactttgaggagaagaatcaatctgtattaccaaaaaaaaaatgttttcattttctgtaagatacaatgaactggtacattaaaagtcaattttgtgttactgcagtatcttttaattcttctgagttgtagaatcttagctatttttctttgtgtcaaactctgtcaatacattatttccaaga

SEQ ID NO: 300577 - DNA, 2906 bp, Homo sapiens
  misc_feature (82)..(82): n is a, c, g, or t
  misc_feature (2515)..(2515): n is a, c, g, or t
  misc_feature (2523)..(2523): n is a, c, g, or t
  misc_feature (2582)..(2582): n is a, c, g, or t
  misc_feature (2812)..(2812): n is a, c, g, or t
aaccccagagcgggatactcgggatctgagcagaggggaaagtcatctaagaggctgctgctttacaaggtctgggcacagngctgcccctcccttcctccctgaagtttgcatgaagtgcacattaggctgtaattaggggatttgggaggagaactttcctggtgacgctttgcttttcttctgctcttggtgagaaagtgcctccttcttcccaggatcaggacctctgccatccagcgccacaaagagacattctgcacacacactcacacacacacacacacacacactctcacactcgcccagagacaaacttaaggtgaggagaaagagcgctagcttcacttgatctccagcttccaacttaagcagaacttgagagcatccgaactcctggatttcaggacaagtgaagaagattctttgggctataaagatgaagagtctacttcttctggtgctgatttcaatctgctgggctgatcatctttcagacaactatactctggatcatgacagagctattcacatccaagcagaaaatggcccccatctacttgtggaagcagagcaagccaaggtgttttcacacagaggtggcaatgttacactgccatgtaaattttatcgagaccctacagcatttggctcaggaatccataaaatccgaattaagtggaccaagctaacttcggattacctcaaggaagtggatgtttttgtttccatgggataccacaaaaaaacctatggaggctaccagggtagagtgtttctgaagggaggcagtgatagtgatgcttctctggtcatcacagacctcactctggaagattatgggagatataagtgtgaggtgattgaaggattagaagatgatactgttgtggtagcactggacttacaaggtgtggtattcccttactttccacgactggggcgctacaatctcaattttcacgaggcgcagcaggcgtgtctggaccaggatgctgtgatcgcctccttcgaccagctgtacgacgcctggcggggcgggctggactggtgcaatgccggctggctcagtgatggctctgtgcaatatcccatcacaaagcccagagagccctgtgggggccagaacacagtgcccggagtcaggaactacggattttgggataaagataaaagcagatatgatgttttctgttttacatccaatttcaatggccgtttttactatctgatccaccccaccaaactgacctatgatgaagcggtgcaagcttgtctcaatgatggtgctcagattgcaaaagtgggccagatatttgctgcctggaaaattctcggatatgaccgctgtgatgcgggctggttggcggatggcagcgtccgctaccccatctctaggccaagaaggcgctgcagtcctactgaggctgcagtgcgcttcgtgggtttcccagataaaaagcataagctgtatggtgtctactgcttcagagcatacaactgaatgtgcccttagagcgcatcagttttaaagtcattaagaacatgtgaaaggtgttttttttttccaatatgaactcatgcaagttaccaaaactgtgataacccttttttacttactgtaaagagtcattttcataaagatcaattcattgatttgttttttgtaaagctatcattcaatatatattataaattaatataaatttaagggaagctctatgtaaggagacttagagccaaactgtttaagctgtatcatcccaacaaagtatcctttcatgaacggggcatgcaatagcttaagaattgctaggattaaattaaggaaagtaaagctactcagagcagcaggttccacaagcacaaactttacacatttgtacaattttgaaatgcactacaataaacaaattagagcaacacatttgaaatacaggcttctttacataaactgagaggttatacaaaactcagtttcacaagggaacaatctatacctttctaaaagttaatatttcaagtctctaataggcagaatattttactctttaaaatcctgcctttctgaccaaaaaaaaaaaaaaaaattcatatggattccaatccatagttaacaagcacagttaaaactcctcaataatcccatttatatgaagcatgacacataaataagcagataatatttaaccaatgaaaaagacttctaccttcttataattaaaattacacatgtctaagaggaattgttttatcttttgagtagctttaccgagttgtatttaaattctaagggccatttgctaagcagcatttagcatctactcagggcagttatatagataaactgctggacagaaaaattgtaaaatttagcagcttgattttctgttagcctatgaaatgttattgtcctataaaaataactttaaactgatttaatatttcatatttacattatatgaaaatcaattacattataaaaggaatccctggaaatcccttaatgggcagnaaaaacanaaaggatgggccaaaccttttcaaaaaaaattcttaatttaatttccttattttgggtnattaataccaacggaggaggaaacccaaaccacggtgggcctgggtggtttttggggggggggggaaaaaaaggtcaaaccaggtgggtaggtttcttaaaaaccttttatcccccaaaaacaaggaaaaaaatggtgggggttaaatgggatggtcaccttttccttgggctggggtcaatccatttaaggggctttaaaaattaaaaatggcttggaaaagcttggtncatcaaaaagggaggtttttaccaccttaaaaaaatccttcagggggccttttaaaaataaaaaaaggggttaaaggtccaggcttccaaaaac

SEQ ID NO: 300578 - DNA, 743 bp, Homo sapiens
  misc_feature (30)..(30): n is a, c, g, or t
  misc_feature (660)..(660): n is a, c, g, or t
tcacgacacgacaaacggtcgagcaatacnaaaaagcaccaccacaccaaccgctggtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaagtnaaaaaaaaaacaattggcctcactggccctcagaggtggaagtcctgcaggccccttcctttgagagaggggtgaatcaagga

SEQ ID NO: 300579 - DNA, 944 bp, Homo sapiens
cattatatttattgtatcttcatttgaacaaattattactacttttggagcagactttatctgttagcaagctgtagttggaacacattaatgctgattagtattgcaggaagaattttattttgaatgttctatcaagagtttttctttatatgatatgaaacacaaattagttatgttttttgtctttatgcataactgtatgtacacattttatagtgaaagaataacagaaaactattatttcttccagcaagtcctcagccttaaacataggtatatttttctctaccctacccccttctttttttctaccctaaataaaagatatttctggctctctgatgaagaaaaaaatatggaaattgagtatatgtatgtttaactcagagatataaaaaaacctaaaaagaaaacttgtcatacaaatattataagtagccttaacaagatgtggtactgcatggactgtttattccctgccaagtttctctataattgatcttccagtttcataaaagaccttactggttctgaaattttgtatttgttacccaagtttcttattttattttttttttaaataaaagattgtagatgtaattagacaagaggttttagagagtagtcaagtaacatttgttcatcatttacaggcatttgcaagtaaaatcactggcatgttgttggaattatccccagctcagctgcttctccttctagcaagtgaggattctctgagagcaagagtggatgaggccatggaactcattattgcacatggacggtaatgtgtacaattgggaaggcatttcagtttaaacatcagctacttactttcagtatgtgggtgccatcatatcttaaaatttatgtcataaagtataagactttaaatgcatttttatttattttttaaatgatagcttaaattccatgaatga

SEQ ID NO: 300580 - DNA, 491 bp, Homo sapiens
tatgatagcatgctgaagtggcttctgtttggattggagatgaatcttgttaaagtccaacccaccaactgaacaggaaactcatgggatgtagctacaagcaactttcctccccttctctctccactcccggggtggagagagaaagggaaatgaggaggagtagtggtttgcgagcaggttctcggagggaccgggataggtaaattttgtatctttgattcaataccacctttttggatgaattagagataggcctgtaaatgaaagaatcttaattatggattattttttagaaaagtaaagttttaattttgaacatatgtatagtaactaagaatagtctgttaataaaatacaataactaagaatagtctattaactaataaaaagttctgctttaaaaacccagaggcggttgaaattatattctttttatctgactcaagttcctatttgaatttttttacccatatcattctctcctaagt

SEQ ID NO: 300581 - DNA, 357 bp, Homo sapiens
  misc_feature (324)..(324): n is a, c, g, or t
  misc_feature (336)..(336): n is a, c, g, or t
  misc_feature (346)..(346): n is a, c, g, or t
  misc_feature (353)..(353): n is a, c, g, or t
cattcaaatatccacacaatactttaattacatgtctattcaatgtgataggacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggatatttgaatgggggatcnactagagtcggnctgcaggaangggagtncaaa

SEQ ID NO: 300582 - DNA, 10525 bp, Homo sapiens
cgccctcgagtggaggacgagaaggaaagcaccatgacgtccatccatttcgtggttcacccgctgccgggcaccgaggaccagctcaatgacaggttacgagaagtttctgagaagctgaacaaatataatttaaacagccacccccctttgaatgtattggaacaggctactattaaacagtgtgtggtgggaccaaatcatgctgcctttcttcttgaggatggtagagtttgcaggattggtttttcagtacagccagacagattggaattgggtaaacctgataataatgatgggtcaaagttgaacagcaactcgggggcagggaggacgtcaaggcctggtaggacaagcgactctccatggtttctctcaggttctgagactctaggcaggctggcaggcaacaccttaggaagccgctggagttctggagtgggtggaagtggtggaggatcctctggtaggtcatcagctggagctcgagattcccgccggcagactcgagttattcggacaggacgggatcgagggtctgggcttttgggcagtcagccccagccagttattccagcatctgtcattccagaggagctgatttcacaggcccaagttgttttacaaggcaaatccagaagtgtcattattcgagaacttcagagaacaaatcttgatgtgaaccttgctgtaaataatttacttagccgggatgatgaagatggagatgatggggatgatacagccagcgaatcttatttgcctggagaggatcttatgtctctccttgatgccgacattcattctgcccacccaagtgtcattattgatgcagatgccatgttttctgaagacattagctattttggttacccttcttttcgtcgttcatcactttccaggctaggctcatctcgagttctccttcttcccttagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggatggaacaaaattcatctgtattggggctctgtattctgaacttctggctgtcagcagtaaaggagaactttatcagtggaaatggagtgaatctgagccttacagaaatgcccagaatccttcattacatcatccacgagcaacatttttggggttaaccaatgaaaagatagtcctcctgtctgcaaatagcataagagcaactgtagctacagaaaataacaaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggggtgtagttccttttagtcaaaggaagaaaatgttagagaaagctagagcaaaaaataaaaagcctaaatccagtgctggtatttcttcaatgccgaacatcactgttggtacccaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccacgtgtagtgatgcatcctcaattgccagcagtgcatcaatgccatacaaacgacgacggtcaacccctgcaccaaaagaagaggaaaaggtgaatgaagagcagtggtctcttcgggaagtggtttttgtggaagatgtcaagaatgttcctgttggcaaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggttgtcaaaactggtggaacaccgaaggttcccgactgtttccaaaggactcctaaaaagctttgtatacctgaaaaaacagaaatattagcagtgaatgtagattccaaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaacttctttctgccaaggatgcaagagggatgaccccatttatgtcagctgtaagtggccgagcttatcctgctgcaattaccatcttagaaactgctcagaaaattgcaaaagctgaaatatcctcaagtgaaaaagaggaagatgtattcatgggaatggtttgcccatcaggtaccaaccctgatgactctcctttatatgttttatgttgtaatgacacttgcagttttacatggactggagcagagcacattaaccaggatatttttgagtgtcgaacttgtggcttgctggagtcactgtgttgttgtacggaatgtgcaagggtttgtcataaaggtcatgattgcaaactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggggagagcacctcttactattcttagtacagacagtcgcaaggcagacggtggagcattgtcaatacaggccacctcgaatcagggaagatcgtaaccgaaaaacagccagtcctgaagattcagatatgccagatcatgatttagagcctccaagatttgcccagcttgcattggagcgtgttctacaggactggaatgccttgaaatctatgattatgtttgggtcgcaggagaataaagaccctcttagtgccagcagtagaataggccatcttttgccagaagagcaagtatacctcaatcagcaaagtggcacaattcggctggactgtttcactcattgccttatagttaagtgtacagcagatattttgcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaacaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcagctccagtcagtctcagtcatcctacatcatcaggaatccacagcagaggcgcatcagccagtcacagcccgttcggggcagagatgaagaacaggatgatattgtttcagcagatgtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagtttttatttatgtagttgtacatttttaaactaagggcaatacactgacatggttatgtgcataaaaattttgacttaaagaactggaagtttatatacacctggactataagaaacagaagaaaatcagtccacattttacagttagcagagaatcctaaatggcactggcctggccaccttttcattttacaaatgggggaagtgaagtgtgaccccttacttggcataggaagttaacttacacctaataactgacaggtttttgttttgatgacctattaattatgtagcctaggattaatatcccaaaattactctggtttaagtagctttattcagtggcataataacactgttttcttccttaagtcttcaatgaagtgacttaaaacagtcactttacatattaaaaatgaggagagcaattctctggaatctctcctttcagttcctttgtaggatttctggccttgaggatagtcttcatgttcaaaggcactatgcttttattatataacttccttcagaagactgaaccacatgatattctcagccctgttaacactaaaaatatttaaaactgaatgatagtagtgactcattgtattacttaaaacttatataacacgctgtattagatgtgtgtaaattagccaaaggttattttacaaagtgagacattggtttttatgtctaaatgctatttctgaataaatgaaatagtaattagatcaagagctgattagcatcaatgtgtttgaaagatataaaatttatacatcaccttaacctctgtatgcacatgatgggattgataaaatattaaatgagaacaaactagatatgattaggacatttgaaaccctaattgtgaatttatttttaatagttactgaaatgaaaatatttaaaataatgcacaatgtcttaagtcttcctaaatcaagattttggttaaaaaatacttctaataatagtaaaagattttttttttaagtaaatcataaaacggttctaaatgtaaaataaagacatgtaaaataaagttctcttttggtcttgtttagtgtttaaatctaacaattgaaaacaaatttaggaagagaag

SEQ ID NO: 300583 - DNA, 10455 bp, Homo sapiens
cgccctcgagtggaggacgagaaggaaagcaccatgacgtccatccatttcgtggttcacccgctgccgggcaccgaggaccagctcaatgacaggttacgagaagtttctgagaagctgaacaaatataatttaaacagccacccccctttgaatgtattggaacaggctactattaaacagtgtgtggtgggaccaaatcatgctgcctttcttcttgaggatggtagagtttgcaggattggtttttcagtacagccagacagattggaattgggtaaacctgataataatgatgggtcaaagttgaacagcaactcgggggcagggaggacgtcaaggcctggtaggacaagcgactctccatggtttctctcaggttctgagactctaggcaggctggcaggcaacaccttaggaagccgctggagttctggagtgggtggaagtggtggaggatcctctggtaggtcatcagctggagctcgagattcccgccggcagactcgagttattcggacaggacgggatcgagggtctgggcttttgggcagtcagccccagccagttattccagcatctgtcattccagaggagctgatttcacaggcccaagttgttttacaaggcaaatccagaagtgtcattattcgagaacttcagagaacaaatcttgatgtgaaccttgctgtaaataatttacttagccgggatgatgaagatggagatgatggggatgatacagccagcgaatcttatttgcctggagaggatcttatgtctctccttgatgccgacattcattctgcccacccaagtgtcattattgatgcagatgccatgttttctgaagacattagctattttggttacccttcttttcgtcgttcatcactttccaggctaggctcatctcgagttctccttcttcccttagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggatggaacaaaattcatctgtattggggctctgtattctgaacttctggctgtcagcagtaaaggagaactttatcagtggaaatggagtgaatctgagccttacagaaatgcccagaatccttcattacatcatccacgagcaacatttttggggttaaccaatgaaaagatagtcctcctgtctgcaaatagcataagagcaactgtagctacagaaaataacaaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggggtgtagttccttttagtcaaaggaagaaaatgttagagaaagctagagcaaaaaataaaaagcctaaatccagtgctggtatttcttcaatgccgaacatcactgttggtacccaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccacgtgtagtgatgcatcctcaattgccagcagtgcatcaatgccatacaaacgacgacggtcaacccctgcaccaaaagaagaggaaaaggtgaatgaagagcagtggtctcttcgggaagtggtttttgtggaagatgtcaagaatgttcctgttggcaaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggttgtcaaaactggtggaacaccgaaggttcccgactgtttccaaaggactcctaaaaagctttgtatacctgaaaaaacagaaatattagcagtgaatgtagattccaaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaacttctttctgccaaggatgcaagagggatgaccccatttatgtcagctgtaagtggccgagcttatcctgctgcaattaccatcttagaaactgctcagaaaattgcaaaagctgaaatatcctcaagtgaaaaagaggaagatgtattcatgggaatggtttgcccatcaggtaccaaccctgatgactctcctttatatgttttatgttgtaatgacacttgcagttttacatggactggagcagagcacattaaccaggatatttttgagtgtcgaacttgtggcttgctggagtcactgtgttgttgtacggaatgtgcaagggtttgtcataaaggtcatgattgcaaactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggggagagcacctcttactattcttagtacagacagtcgcaaggcagacggtggagcattgtcaatacaggccacctcgaatcagggaagatcgtaaccgaaaaacagccagtcctgaagattcagatatgccagatcatgatttagagcctccaagatttgcccagcttgcattggagcgtgttctacaggactggaatgccttgaaatctatgattatgtttgggtcgcaggagaataaagaccctcttagtgccagcagtagaataggccatcttttgccagaagagcaagtatacctcaatcagcaaagtggcacaattcggctggactgtttcactcattgccttatagttaagtgtacagcagatattttgcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaacaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcagctccagtcagtctcagtcatcctacatcatcaggaatccacagcagaggcgcatcagccagtcacagcccgttcggggcagagatgaagaacaggatgatattgtttcagcagatgtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagtttttatttatgtagttgtacatttttaaactaagggcaatacactgacatggttatgtgcataaaaattttgacttaaagaactggaagtttatatacacctggactataagaaacagaagaaaatcagtccacattttacagttagcagagaatcctaaatggcactggcctggccaccttttcattttacaaatgggggaagtgaagtgtgaccccttacttggcataggaagttaacttacacctaataactgacaggtttttgttttgatgacctattaattatgtagcctaggattaatatcccaaaattactctggtttaagtagctttattcagtggcataataacactgttttcttccttaagtcttcaatgaagtgacttaaaacagtcactttacatattaaaaatgaggagagcaattctctggaatctctcctttcagttcctttgtaggatttctggccttgaggatagtcttcatgttcaaaggcactatgcttttattatataacttccttcagaagactgaaccacatgatattctcagccctgttaacactaaaaatatttaaaactgaatgatagtagtgactcattgtattacttaaaacttatataacacgctgtattagatgtgtgtaaattagccaaaggttattttacaaagtgagacattggtttttatgtctaaatgctatttctgaataaatgaaatagtaattagatcaagagctgattagcatcaatgtgtttgaaagatataaaatttatacatcaccttaacctctgtatgcacatgatgggattgataaaatattaaatgagaacaaactagatatgattaggacatttgaaaccctaattgtgaatttatttttaatagttactgaaatgaaaatatttaaaataatgcacaatgtcttaagtcttcctaaatcaagattttggttaaaaaatacttctaataatagtaaaagattttttttttaagtaaatcataaaacggttctaaatgtaaaataaagacatgta

SEQ ID NO: 300584 - DNA, 9396 bp, Homo sapiens
cgccctcgagtggaggacgagaaggaaagcaccatgacgtccatccatttcgtggttcacccgctgccgggcaccgaggaccagctcaatgacaggttacgagaagtttctgagaagctgaacaaatataatttaaacagccacccccctttgaatgtattggaacaggctactattaaacagtgtgtggtgggaccaaatcatgctgcctttcttcttgaggatggtagagtttgcaggattggtttttcagtacagccagacagattggaattgggtaaacctgataataatgatgggtcaaagttgaacagcaactcgggggcagggaggacgtcaaggcctggtaggacaagcgactctccatggtttctctcaggttctgagactctaggcaggctggcaggcaacaccttaggaagccgctggagttctggagtgggtggaagtggtggaggatcctctggtaggtcatcagctggagctcgagattcccgccggcagactcgagttattcggacaggacgggatcgagggtctgggcttttgggcagtcagccccagccagttattccagcatctgtcattccagaggagctgatttcacaggcccaagttgttttacaaggcaaatccagaagtgtcattattcgagaacttcagagaacaaatcttgatgtgaaccttgctgtaaataatttacttagccgggatgatgaagatggagatgatggggatgatacagccagcgaatcttatttgcctggagaggatcttatgtctctccttgatgccgacattcattctgcccacccaagtgtcattattgatgcagatgccatgttttctgaagacattagctattttggttacccttcttttcgtcgttcatcactttccaggctaggctcatctcgagttctccttcttcccttagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggatggaacaaaattcatctgtattggggctctgtattctgaacttctggctgtcagcagtaaaggagaactttatcagtggaaatggagtgaatctgagccttacagaaatgcccagaatccttcattacatcatccacgagcaacatttttggggttaaccaatgaaaagatagtcctcctgtctgcaaatagcataagagcaactgtagctacagaaaataacaaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggggtgtagttccttttagtcaaaggaagaaaatgttagagaaagctagagcaaaaaataaaaagcctaaatccagtgctggtatttcttcaatgccgaacatcactgttggtacccaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccacgtgtagtgatgcatcctcaattgccagcagtgcatcaatgccatacaaacgacgacggtcaacccctgcaccaaaagaagaggaaaaggtgaatgaagagcagtggtctcttcgggaagtggtttttgtggaagatgtcaagaatgttcctgttggcaaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggttgtcaaaactggtggaacaccgaaggttcccgactgtttccaaaggactcctaaaaagctttgtatacctgaaaaaacagaaatattagcagtgaatgtagattccaaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaacttctttctgccaaggatgcaagagggatgaccccatttatgtcagctgtaagtggccgagcttatcctgctgcaattaccatcttagaaactgctcagaaaattgcaaaagctgaaatatcctcaagtgaaaaagaggaagatgtattcatgggaatggtttgcccatcaggtaccaaccctgatgactctcctttatatgttttatgttgtaatgacacttgcagttttacatggactggagcagagcacattaaccaggatatttttgagtgtcgaacttgtggcttgctggagtcactgtgttgttgtacggaatgtgcaagggtttgtcataaaggtcatgattgcaaactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggggagagcacctcttactattcttagtacagacagtcgcaaggcagacggtggagcattgtcaatacaggccacctcgaatcagggaagatcgtaaccgaaaaacagccagtcctgaagattcagatatgccagatcatgatttagagcctccaagatttgcccagcttgcattggagcgtgttctacaggactggaatgccttgaaatctatgattatgtttgggtcgcaggagaataaagaccctcttagtgccagcagtagaataggccatcttttgccagaagagcaagtatacctcaatcagcaaagtggcacaattcggctggactgtttcactcattgccttatagttaagtgtacagcagatattttgcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaacaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcagctccagtcagtctcagtcatcctacatcatcaggaatccacagcagaggcgcatcagccagtcacagcccgttcggggcagagatgaagaacaggatgatattgtttcagcagatgtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagta

SEQ ID NO: 300585 - DNA, 10471 bp, Homo sapiens
cgccctcgagtggaggacgagaaggaaagcaccatgacgtccatccatttcgtggttcacccgctgccgggcaccgaggaccagctcaatgacaggttacgagaagtttctgagaagctgaacaaatataatttaaacagccacccccctttgaatgtattggaacaggctactattaaacagtgtgtggtgggaccaaatcatgctgcctttcttcttgaggatggtagagtttgcaggattggtttttcagtacagccagacagattggaattgggtaaacctgataataatgatgggtcaaagttgaacagcaactcgggggcagggaggacgtcaaggcctggtaggacaagcgactctccatggtttctctcaggttctgagactctaggcaggctggcaggcaacaccttaggaagccgctggagttctggagtgggtggaagtggtggaggatcctctggtaggtcatcagctggagctcgagattcccgccggcagactcgagttattcggacaggacgggatcgagggtctgggcttttgggcagtcagccccagccagttattccagcatctgtcattccagaggagctgatttcacaggcccaagttgttttacaaggcaaatccagaagtgtcattattcgagaacttcagagaacaaatcttgatgtgaaccttgctgtaaataatttacttagccgggatgatgaagatggagatgatggggatgatacagccagcgaatcttatttgcctggagaggatcttatgtctctccttgatgccgacattcattctgcccacccaagtgtcattattgatgcagatgccatgttttctgaagacattagctattttggttacccttcttttcgtcgttcatcactttccaggctaggctcatctcgagttctccttcttcccttagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggatggaacaaaattcatctgtattggggctctgtattctgaacttctggctgtcagcagtaaaggagaactttatcagtggaaatggagtgaatctgagccttacagaaatgcccagaatccttcattacatcatccacgagcaacatttttggggttaaccaatgaaaagatagtcctcctgtctgcaaatagcataagagcaactgtagctacagaaaataacaaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggggtgtagttccttttagtcaaaggaagaaaatgttagagaaagctagagcaaaaaataaaaagcctaaatccagtgctggtatttcttcaatgccgaacatcactgttggtacccaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccacgtgtagtgatgcatcctcaattgccagcagtgcatcaatgccatacaaacgacgacggtcaacccctgcaccaaaagaagaggaaaaggtgaatgaagagcagtggtctcttcgggaagtggtttttgtggaagatgtcaagaatgttcctgttggcaaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggttgtcaaaactggtggaacaccgaaggttcccgactgtttccaaaggactcctaaaaagctttgtatacctgaaaaaacagaaatattagcagtgaatgtagattccaaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaacttctttctgccaaggatgcaagagggatgaccccatttatgtcagctgtaagtggccgagcttatcctgctgcaattaccatcttagaaactgctcagaaaattgcaaaagctgaaatatcctcaagtgaaaaagaggaagatgtattcatgggaatggtttgcccatcaggtaccaaccctgatgactctcctttatatgttttatgttgtaatgacacttgcagttttacatggactggagcagagcacattaaccaggatatttttgagtgtcgaacttgtggcttgctggagtcactgtgttgttgtacggaatgtgcaagggtttgtcataaaggtcatgattgcaaactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggggagagcacctcttactattcttagtacagacagtcgcaaggcagacggtggagcattgtcaatacaggccacctcgaatcagggaagatcgtaaccgaaaaacagccagtcctgaagattcagatatgccagatcatgatttagagcctccaagatttgcccagcttgcattggagcgtgttctacaggactggaatgccttgaaatctatgattatgtttgggtcgcaggagaataaagaccctcttagtgccagcagtagaataggccatcttttgccagaagagcaagtatacctcaatcagcaaagtggcacaattcggctggactgtttcactcattgccttatagttaagtgtacagcagatattttgcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaacaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcagctccagtcagtctcagtcatcctacatcatcaggaatccacagcagaggcgcatcagccagtcacagcccgttcggggcagagatgaagaacaggatgatattgtttcagcagatgtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagtttttatttatgtagttgtacatttttaaactaagggcaatacactgacatggttatgtgcataaaaattttgacttaaagaactggaagtttatatacacctggactataagaaacagaagccaccttttcattttacaaatgggggaagtgaagtgtgaccccttacttggcataggaagttaacttacacctaataactgacaggtttttgttttgatgacctattaattatgtagcctaggattaatatcccaaaattactctggtttaagtagctttattcagtggcataataacactgttttcttccttaagtcttcaatgaagtgacttaaaacagtcactttacatattaaaaatgaggagagcaattctctggaatctctcctttcagttcctttgtaggatttctggccttgaggatagtcttcatgttcaaaggcactatgcttttattatataacttccttcagaagactgaaccacatgatattctcagccctgttaacactaaaaatatttaaaactgaatgatagtagtgactcattgtattacttaaaacttatataacacgctgtattagatgtgtgtaaattagccaaaggttattttacaaagtgagacattggtttttatgtctaaatgctatttctgaataaatgaaatagtaattagatcaagagctgattagcatcaatgtgtttgaaagatataaaatttatacatcaccttaacctctgtatgcacatgatgggattgataaaatattaaatgagaacaaactagatatgattaggacatttgaaaccctaattgtgaatttatttttaatagttactgaaatgaaaatatttaaaataatgcacaatgtcttaagtcttcctaaatcaagattttggttaaaaaatacttctaataatagtaaaagattttttttttaagtaaatcataaaacggttctaaatgtaaaataaagacatgtaaaataaagttctcttttggtcttgtttagtgtttaaatctaacaattgaaaacaaatttaggaagagaag

SEQ ID NO: 300586 - DNA, 9084 bp, Homo sapiens
cgccctcgagtggaggacgagaaggaaagcaccatgacgtccatccatttcgtggttcacccgctgccgggcaccgaggaccagctcaatgacaggttacgagaagtttctgagaagctgaacaaatataatttaaacagccacccccctttgaatgtattggaacaggctactattaaacagtgtgtggtgggaccaaatcatgctgcctttcttcttgaggatggtagagtttgcaggattggtttttcagtacagccagacagattggaattgggtaaacctgataataatgatgggtcaaagttgaacagcaactcgggggcagggaggacgtcaaggcctggtaggacaagcgactctccatggtttctctcaggttctgagactctaggcaggctggcaggcaacaccttaggaagccgctggagttctggagtgggtggaagtggtggaggatcctctggtaggtcatcagctggagctcgagattcccgccggcagactcgagttattcggacaggacgggatcgagggtctgggcttttgggcagtcagccccagccagttattccagcatctgtcattccagaggagctgatttcacaggcccaagttgttttacaaggcaaatccagaagtgtcattattcgagaacttcagagaacaaatcttgatgtgaaccttgctgtaaataatttacttagccgggatgatgaagatggagatgatggggatgatacagccagcgaatcttatttgcctggagaggatcttatgtctctccttgatgccgacattcattctgcccacccaagtgtcattattgatgcagatgccatgttttctgaagacattagctattttggttacccttcttttcgtcgttcatcactttccaggctaggctcatctcgagttctccttcttcccttagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggatggaacaaaattcatctgtattggggctctgtattctgaacttctggctgtcagcagtaaaggagaactttatcagtggaaatggagtgaatctgagccttacagaaatgcccagaatccttcattacatcatccacgagcaacatttttggggttaaccaatgaaaagatagtcctcctgtctgcaaatagcataagagcaactgtagctacagaaaataacaaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggggtgtagttccttttagtcaaaggaagaaaatgttagagaaagctagagcaaaaaataaaaagcctaaatccagtgctggtatttcttcaatgccgaacatcactgttggtacccaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccacgtgtagtgatgcatcctcaattgccagcagtgcatcaatgccatacaaacgacgacggtcaacccctgcaccaaaagaagaggaaaaggtgaatgaagagcagtggtctcttcgggaagtggtttttgtggaagatgtcaagaatgttcctgttggcaaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggttgtcaaaactggtggaacaccgaaggttcccgactgtttccaaaggactcctaaaaagctttgtatacctgaaaaaacagaaatattagcagtgaatgtagattccaaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaacttctttctgccaaggatgcaagagggatgaccccatttatgtcagctgtaagtggccgagcttatcctgctgcaattaccatcttagaaactgctcagaaaattgcaaaagctgaaatatcctcaagtgaaaaagaggaagatgtattcatgggaatggtttgcccatcaggtaccaaccctgatgactctcctttatatgttttatgttgtaatgacacttgcagttttacatggactggagcagagcacattaaccaggatatttttgagtgtcgaacttgtggcttgctggagtcactgtgttgttgtacggaatgtgcaagggtttgtcataaaggtcatgattgcaaactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggggagagcacctcttactattcttagtacagacagtcgcaaggcagacggtggagcattgtcaatacaggccacctcgaatcagggaagatcgtaaccgaaaaacagccagtcctgaagattcagatatgccagatcatgatttagagcctccaagatttgcccagcttgcattggagcgtgttctacaggactggaatgccttgaaatctatgattatgtttgggtcgcaggagaataaagaccctcttagtgccagcagtagaataggccatcttttgccagaagagcaagtatacctcaatcagcaaagtggcacaattcggctggactgtttcactcattgccttatagttaagtgtacagcagatattttgcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaacaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcagctccagtcagtctcagtcatcctacatcatcaggaatccacagcagaggcgcatcagccagtcacagcccgttcggggcagagatgaagaacaggatgatattgtttcagcagatgtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaaaaaaaaagaaaaatggcctttttagccctaagggagagctctggggccgttgcctttaagagggtaattaatgacctggtctatgactagtgcgttggacgttgggttggcgaagcggatcacttactcaaggcgggaaactgtatccccgaatcggggaaaccgaggaaaacactggacgcaaggcggctaagggcggaaccggaaagggccggtgctgcggttccataggcg

SEQ ID NO: 300587 - DNA, 8907 bp, Homo sapiens
  misc_feature (8824)..(8824): n is a, c, g, or t
cgccctcgagtggaggacgagaaggaaagcaccatgacgtccatccatttcgtggttcacccgctgccgggcaccgaggaccagctcaatgacaggttacgagaagtttctgagaagctgaacaaatataatttaaacagccacccccctttgaatgtattggaacaggctactattaaacagtgtgtggtgggaccaaatcatgctgcctttcttcttgaggatggtagagtttgcaggattggtttttcagtacagccagacagattggaattgggtaaacctgataataatgatgggtcaaagttgaacagcaactcgggggcagggaggacgtcaaggcctggtaggacaagcgactctccatggtttctctcaggttctgagactctaggcaggctggcaggcaacaccttaggaagccgctggagttctggagtgggtggaagtggtggaggatcctctggtaggtcatcagctggagctcgagattcccgccggcagactcgagttattcggacaggacgggatcgagggtctgggcttttgggcagtcagccccagccagttattccagcatctgtcattccagaggagctgatttcacaggcccaagttgttttacaaggcaaatccagaagtgtcattattcgagaacttcagagaacaaatcttgatgtgaaccttgctgtaaataatttacttagccgggatgatgaagatggagatgatggggatgatacagccagcgaatcttatttgcctggagaggatcttatgtctctccttgatgccgacattcattctgcccacccaagtgtcattattgatgcagatgccatgttttctgaagacattagctattttggttacccttcttttcgtcgttcatcactttccaggctaggctcatctcgagttctccttcttcccttagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggatggaacaaaattcatctgtattggggctctgtattctgaacttctggctgtcagcagtaaaggagaactttatcagtggaaatggagtgaatctgagccttacagaaatgcccagaatccttcattacatcatccacgagcaacatttttggggttaaccaatgaaaagatagtcctcctgtctgcaaatagcataagagcaactgtagctacagaaaataacaaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggggtgtagttccttttagtcaaaggaagaaaatgttagagaaagctagagcaaaaaataaaaagcctaaatccagtgctggtatttcttcaatgccgaacatcactgttggtacccaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccacgtgtagtgatgcatcctcaattgccagcagtgcatcaatgccatacaaacgacgacggtcaacccctgcaccaaaagaagaggaaaaggtgaatgaagagcagtggtctcttcgggaagtggtttttgtggaagatgtcaagaatgttcctgttggcaaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggttgtcaaaactggtggaacaccgaaggttcccgactgtttccaaaggactcctaaaaagctttgtatacctgaaaaaacagaaatattagcagtgaatgtagattccaaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaacttctttctgccaaggatgcaagagggatgaccccatttatgtcagctgtaagtggccgagcttatcctgctgcaattaccatcttagaaactgctcagaaaattgcaaaagctgaaatatcctcaagtgaaaaagaggaagatgtattcatgggaatggtttgcccatcaggtaccaaccctgatgactctcctttatatgttttatgttgtaatgacacttgcagttttacatggactggagcagagcacattaaccaggatatttttgagtgtcgaacttgtggcttgctggagtcactgtgttgttgtacggaatgtgcaagggtttgtcataaaggtcatgattgcaaactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggggagagcacctcttactattcttagtacagacagtcgcaaggcagacggtggagcattgtcaatacaggccacctcgaatcagggaagatcgtaaccgaaaaacagccagtcctgaagattcagatatgccagatcatgatttagagcctccaagatttgcccagcttgcattggagcgtgttctacaggactggaatgccttgaaatctatgattatgtttgggtcgcaggagaataaagaccctcttagtgccagcagtagaataggccatcttttgccagaagagcaagtatacctcaatcagcaaagtggcacaattcggctggactgtttcactcattgccttatagttaagtgtacagcagatattttgcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaacaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcagctccagtcagtctcagtcatcctacatcatcaggaatccacagcagaggcgcatcagccagtcacagcccgttcggggcagagatgaagaacaggatgatattgtttcagcagatgtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaagtnaaaaaaaaaacaattggcctcactggccctcagaggtggaagtcctgcaggccccttcctttgagagaggggtgaatcaagga

SEQ ID NO: 300588 - DNA, 10052 bp, Homo sapiens
atccgcctgcctcagcctcccaaagcgctgggattacagatgtgagccaccgtgcccggccacaagtgttatatcttaacgagtgatctttcttgtgattatgtagtaagtagctcaggcgacatttatgcatttgatgttctttaaaatctttgttaataatgtaggttgttgtgtttttcctcaggcgatgtcattccctagtttttaaatgtatgtgaatttttagagctctttcagcagtctacagttgctctttgtgtgtatgctgcagtgatgtttgtttctgtttatagaggatcttatgtctctccttgatgccgacattcattctgcccacccaagtgtcattattgatgcagatgccatgttttctgaagacattagctattttggttacccttcttttcgtcgttcatcactttccaggctaggctcatctcgagttctccttcttcccttagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggatggaacaaaattcatctgtattggggctctgtattctgaacttctggctgtcagcagtaaaggagaactttatcagtggaaatggagtgaatctgagccttacagaaatgcccagaatccttcattacatcatccacgagcaacatttttggggttaaccaatgaaaagatagtcctcctgtctgcaaatagcataagagcaactgtagctacagaaaataacaaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggggtgtagttccttttagtcaaaggaagaaaatgttagagaaagctagagcaaaaaataaaaagcctaaatccagtgctggtatttcttcaatgccgaacatcactgttggtacccaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccacgtgtagtgatgcatcctcaattgccagcagtgcatcaatgccatacaaacgacgacggtcaacccctgcaccaaaagaagaggaaaaggtgaatgaagagcagtggtctcttcgggaagtggtttttgtggaagatgtcaagaatgttcctgttggcaaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggttgtcaaaactggtggaacaccgaaggttcccgactgtttccaaaggactcctaaaaagctttgtatacctgaaaaaacagaaatattagcagtgaatgtagattccaaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaacttctttctgccaaggatgcaagagggatgaccccatttatgtcagctgtaagtggccgagcttatcctgctgcaattaccatcttagaaactgctcagaaaattgcaaaagctgaaatatcctcaagtgaaaaagaggaagatgtattcatgggaatggtttgcccatcaggtaccaaccctgatgactctcctttatatgttttatgttgtaatgacacttgcagttttacatggactggagcagagcacattaaccaggatatttttgagtgtcgaacttgtggcttgctggagtcactgtgttgttgtacggaatgtgcaagggtttgtcataaaggtcatgattgcaaactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggggagagcacctcttactattcttagtacagacagtcgcaaggcagacggtggagcattgtcaatacaggccacctcgaatcagggaagatcgtaaccgaaaaacagccagtcctgaagattcagatatgccagatcatgatttagagcctccaagatttgcccagcttgcattggagcgtgttctacaggactggaatgccttgaaatctatgattatgtttgggtcgcaggagaataaagaccctcttagtgccagcagtagaataggccatcttttgccagaagagcaagtatacctcaatcagcaaagtggcacaattcggctggactgtttcactcattgccttatagttaagtgtacagcagatattttgcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaacaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcagctccagtcagtctcagtcatcctacatcatcaggaatccacagcagaggcgcatcagccagtcacagcccgttcggggcagagatgaagaacaggatgatattgtttcagcagatgtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagtttttatttatgtagttgtacatttttaaactaagggcaatacactgacatggttatgtgcataaaaattttgacttaaagaactggaagtttatatacacctggactataagaaacagaagaaaatcagtccacattttacagttagcagagaatcctaaatggcactggcctggccaccttttcattttacaaatgggggaagtgaagtgtgaccccttacttggcataggaagttaacttacacctaataactgacaggtttttgttttgatgacctattaattatgtagcctaggattaatatcccaaaattactctggtttaagtagctttattcagtggcataataacactgttttcttccttaagtcttcaatgaagtgacttaaaacagtcactttacatattaaaaatgaggagagcaattctctggaatctctcctttcagttcctttgtaggatttctggccttgaggatagtcttcatgttcaaaggcactatgcttttattatataacttccttcagaagactgaaccacatgatattctcagccctgttaacactaaaaatatttaaaactgaatgatagtagtgactcattgtattacttaaaacttatataacacgctgtattagatgtgtgtaaattagccaaaggttattttacaaagtgagacattggtttttatgtctaaatgctatttctgaataaatgaaatagtaattagatcaagagctgattagcatcaatgtgtttgaaagatataaaatttatacatcaccttaacctctgtatgcacatgatgggattgataaaatattaaatgagaacaaactagatatgattaggacatttgaaaccctaattgtgaatttatttttaatagttactgaaatgaaaatatttaaaataatgcacaatgtcttaagtcttcctaaatcaagattttggttaaaaaatacttctaataatagtaaaagattttttttttaagtaaatcataaaacggttctaaatgtaaaataaagacatgtaaaataaagttctcttttggtcttgtttagtgtttaaatctaacaattgaaaacaaatttaggaagagaag

SEQ ID NO: 300589 - DNA, 10643 bp, Homo sapiens
tgcctttcttcttgaggatggtagagtttgcaggattggtttttcagtacagccagacagattggaattgggtaaacctgataataatgatgggtcaaagttggacagcaactcgggggctgggaggacgtcaaggcctgctaggacaaacgactctccatggtttctatcagattctgagactctagacaggctggcaggcaacaccttagggttacgagaagtttctgagaagctgaacaaatataatttaaacagccacccccctttgaatgtattggaacaggctactattaaacagtgtgtggtgggaccaaatcatgctgcctttcttcttgaggatggtagagtttgcaggattggtttttcagtacagccagacagattggaattgggtaaacctgataataatgatgggtcaaagttgaacagcaactcgggggcagggaggacgtcaaggcctggtaggacaagcgactctccatggtttctctcaggttctgagactctaggcaggctggcaggcaacaccttaggaagccgctggagttctggagtgggtggaagtggtggaggatcctctggtaggtcatcagctggagctcgagattcccgccggcagactcgagttattcggacaggacgggatcgagggtctgggcttttgggcagtcagccccagccagttattccagcatctgtcattccagaggagctgatttcacaggcccaagttgttttacaaggcaaatccagaagtgtcattattcgagaacttcagagaacaaatcttgatgtgaaccttgctgtaaataatttacttagccgggatgatgaagatggagatgatggggatgatacagccagcgaatcttatttgcctggagaggatcttatgtctctccttgatgccgacattcattctgcccacccaagtgtcattattgatgcagatgccatgttttctgaagacattagctattttggttacccttcttttcgtcgttcatcactttccaggctaggctcatctcgagttctccttcttcccttagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggatggaacaaaattcatctgtattggggctctgtattctgaacttctggctgtcagcagtaaaggagaactttatcagtggaaatggagtgaatctgagccttacagaaatgcccagaatccttcattacatcatccacgagcaacatttttggggttaaccaatgaaaagatagtcctcctgtctgcaaatagcataagagcaactgtagctacagaaaataacaaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggggtgtagttccttttagtcaaaggaagaaaatgttagagaaagctagagcaaaaaataaaaagcctaaatccagtgctggtatttcttcaatgccgaacatcactgttggtacccaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccacgtgtagtgatgcatcctcaattgccagcagtgcatcaatgccatacaaacgacgacggtcaacccctgcaccaaaagaagaggaaaaggtgaatgaagagcagtggtctcttcgggaagtggtttttgtggaagatgtcaagaatgttcctgttggcaaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggttgtcaaaactggtggaacaccgaaggttcccgactgtttccaaaggactcctaaaaagctttgtatacctgaaaaaacagaaatattagcagtgaatgtagattccaaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaacttctttctgccaaggatgcaagagggatgaccccatttatgtcagctgtaagtggccgagcttatcctgctgcaattaccatcttagaaactgctcagaaaattgcaaaagctgaaatatcctcaagtgaaaaagaggaagatgtattcatgggaatggtttgcccatcaggtaccaaccctgatgactctcctttatatgttttatgttgtaatgacacttgcagttttacatggactggagcagagcacattaaccaggatatttttgagtgtcgaacttgtggcttgctggagtcactgtgttgttgtacggaatgtgcaagggtttgtcataaaggtcatgattgcaaactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggggagagcacctcttactattcttagtacagacagtcgcaaggcagacggtggagcattgtcaatacaggccacctcgaatcagggaagatcgtaaccgaaaaacagccagtcctgaagattcagatatgccagatcatgatttagagcctccaagatttgcccagcttgcattggagcgtgttctacaggactggaatgccttgaaatctatgattatgtttgggtcgcaggagaataaagaccctcttagtgccagcagtagaataggccatcttttgccagaagagcaagtatacctcaatcagcaaagtggcacaattcggctggactgtttcactcattgccttatagttaagtgtacagcagatattttgcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaacaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcagctccagtcagtctcagtcatcctacatcatcaggaatccacagcagaggcgcatcagccagtcacagcccgttcggggcagagatgaagaacaggatgatattgtttcagcagatgtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagtttttatttatgtagttgtacatttttaaactaagggcaatacactgacatggttatgtgcataaaaattttgacttaaagaactggaagtttatatacacctggactataagaaacagaagaaaatcagtccacattttacagttagcagagaatcctaaatggcactggcctggccaccttttcattttacaaatgggggaagtgaagtgtgaccccttacttggcataggaagttaacttacacctaataactgacaggtttttgttttgatgacctattaattatgtagcctaggattaatatcccaaaattactctggtttaagtagctttattcagtggcataataacactgttttcttccttaagtcttcaatgaagtgacttaaaacagtcactttacatattaaaaatgaggagagcaattctctggaatctctcctttcagttcctttgtaggatttctggccttgaggatagtcttcatgttcaaaggcactatgcttttattatataacttccttcagaagactgaaccacatgatattctcagccctgttaacactaaaaatatttaaaactgaatgatagtagtgactcattgtattacttaaaacttatataacacgctgtattagatgtgtgtaaattagccaaaggttattttacaaagtgagacattggtttttatgtctaaatgctatttctgaataaatgaaatagtaattagatcaagagctgattagcatcaatgtgtttgaaagatataaaatttatacatcaccttaacctctgtatgcacatgatgggattgataaaatattaaatgagaacaaactagatatgattaggacatttgaaaccctaattgtgaatttatttttaatagttactgaaatgaaaatatttaaaataatgcacaatgtcttaagtcttcctaaatcaagattttggttaaaaaatacttctaataatagtaaaagattttttttttaagtaaatcataaaacggttctaaatgtaaaataaagacatgtaaaataaagttctcttttggtcttgtttagtgtttaaatctaacaattgaaaacaaatttaggaagagaag

SEQ ID NO: 300590 - DNA, 9994 bp, Homo sapiens
atccgcctgcctcagcctcccaaagcgctgggattacagatgtgagccaccgtgcccggccacaagtgttatatcttaacgagtgatctttcttgtgattatgtagtaagtagctcaggcgacatttatgcatttgatgttctttaaaatctttgttaataatgtaggttgttgtgtttttcctcaggcgatgtcattccctagtttttaaatgtatgtgaatttttagagctctttcagcagtctacagttgctctttgtgtgtatgctgcagtgatgtttgtttctgtttatagaggatcttatgtctctccttgatgccgacattcattctgcccacccaagtgtcattattgatgcagatgccatgttttctgaagacattagctattttggttacccttcttttcgtcgttcatcactttccaggctaggctcatctcgagttctccttcttcccttagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggatggaacaaaattcatctgtattggggctctgtattctgaacttctggctgtcagcagtaaaggagaactttatcagtggaaatggagtgaatctgagccttacagaaatgcccagaatccttcattacatcatccacgagcaacatttttggggttaaccaatgaaaagatagtcctcctgtctgcaaatagcataagagcaactgtagctacagaaaataacaaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggggtgtagttccttttagtcaaaggaagaaaatgttagagaaagctagagcaaaaaataaaaagcctaaatccagtgctggtatttcttcaatgccgaacatcactgttggtacccaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccacgtgtagtgatgcatcctcaattgccagcagtgcatcaatgccatacaaacgacgacggtcaacccctgcaccaaaagaagaggaaaaggtgaatgaagagcagtggtctcttcgggaagtggtttttgtggaagatgtcaagaatgttcctgttggcaaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggttgtcaaaactggtggaacaccgaaggttcccgactgtttccaaaggactcctaaaaagctttgtatacctgaaaaaacagaaatattagcagtgaatgtagattccaaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaacttctttctgccaaggatgcaagagggatgaccccatttatgtcagctgtaagtggccgagcttatcctgctgcaattaccatcttagaaactgctcagaaaattgcaaaagctgaaatatcctcaagtgaaaaagaggaagatgtattcatgggaatggtttgcccatcaggtaccaaccctgatgactctcctttatatgttttatgttgtaatgacacttgcagttttacatggactggagcagagcacattaaccaggatatttttgagtgtcgaacttgtggcttgctggagtcactgtgttgttgtacggaatgtgcaagggtttgtcataaaggtcatgattgcaaactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggggagagcacctcttactattcttagtacagacagtcgcaaggcagacggtggagcattgtcaatacaggccacctcgaatcagggaagatcgtaaccgaaaaacagccagtcctgaagattcagatatgccagatcatgatttagagcctccaagatttgcccagcttgcattggagcgtgttctacaggactggaatgccttgaaatctatgattatgtttgggtcgcaggagaataaagaccctcttagtgccagcagtagaataggccatcttttgccagaagagcaagtatacctcaatcagcaaagtggcacaattcggctggactgtttcactcattgccttatagttaagtgtacagcagatattttgcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaacaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcagctccagtcagtctcagtcatcctacatcatcaggaatccacagcagaggcgcatcagccagtcacagcccgttcggggcagagatgaagaacaggatgatattgtttcagcagatgtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagtttttatttatgtagttgtacatttttaaactaagggcaatacactgacatggttatgtgcataaaaattttgacttaaagaactggaagtttatatacacctggactataagaaacagaagaaaatcagtccacattttacagttagcagagaatcctaaatggcactggcctggccaccttttcattttacaaatgggggaagtgaagtgtgaccccttacttggcataggaagttaacttacacctaataactgacaggtttttgttttgatgacctattaattatgtagcctaggattaatatcccaaaattactctggtttaagtagctttattcagtggcataataacactgttttcttccttaagtcttcaatgaagtgacttaaaacagtcactttacatattaaaaatgaggagagcaattctctggaatctctcctttcagttcctttgtaggatttctggccttgaggatagtcttcatgttcaaaggcactatgcttttattatataacttccttcagaagactgaaccacatgatattctcagccctgttaacactaaaaatatttaaaactgaatgatagtagtgactcattgtattacttaaaacttatataacacgctgtattagatgtgtgtaaattagccaaaggttattttacaaagtgagacattggtttttatgtctaaatgctatttctgaataaatgaaatagtaattagatcaagagctgattagcatcaatgtgtttgaaagatataaaatttatacatcaccttaacctctgtatgcacatgatgggattgataaaatattaaatgagaacaaactagatatgattaggacatttgaaaccctaattgtgaatttatttttaatagttactgaaatgaaaatatttaaaataatgcacaatgtcttaagtcttcctaaatcaagattttggttaaaaaatacttctaataatagtaaaagattttttttttaagtaaatcataaaacggttctaaatgtaaaataaagacatgtaaaataaagttctcttttggtcttgtttagtgtttaaatctaacaattgaaaacaaatttaggaagagaag

SEQ ID NO: 300591 - DNA, 5810 bp, Homo sapiens
  misc_feature (89)..(89): n is a, c, g, or t
ctattttatctaaataactgcgctgtaacaaactttgtgttagacagttgaaactgttagagttgggggctctgctttttccccctggnaattttcccttggtataagatgtgctagattaatttcattgtgaggtgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagtttttatttatgtagttgtacatttttaaactaagggcaatacactgacatggttatgtgcataaaaattttgacttaaagaactggaagtttatatacacctggactataagaaacagaagaaaatcagtccacattttacagttagcagagaatcctaaatggcactggcctggccaccttttcattttacaaatgggggaagtgaagtgtgaccccttacttggcataggaagttaacttacacctaataactgacaggtttttgttttgatgacctattaattatgtagcctaggattaatatcccaaaattactctggtttaagtagctttattcagtggcataataacactgttttcttccttaagtcttcaatgaagtgacttaaaacagtcactttacatattaaaaatgaggagagcaattctctggaatctctcctttcagttcctttgtaggatttctggccttgaggatagtcttcatgttcaaaggcactatgcttttattatataacttccttcagaagactgaaccacatgatattctcagccctgttaacactaaaaatatttaaaactgaatgatagtagtgactcattgtattacttaaaacttatataacacgctgtattagatgtgtgtaaattagccaaaggttattttacaaagtgagacattggtttttatgtctaaatgctatttctgaataaatgaaatagtaattagatcaagagctgattagcatcaatgtgtttgaaagatataaaatttatacatcaccttaacctctgtatgcacatgatgggattgataaaatattaaatgagaacaaactagatatgattaggacatttgaaaccctaattgtgaatttatttttaatagttactgaaatgaaaatatttaaaataatgcacaatgtcttaagtcttcctaaatcaagattttggttaaaaaatacttctaataatagtaaaagattttttttttaagtaaatcataaaacggttctaaatgtaaaataaagacatgtaaaataaagttctcttttggtcttgtttagtgtttaaatctaacaattgaaaacaaatttaggaagagaag

SEQ ID NO: 300592 - DNA, 10007 bp, Homo sapiens
atccgcctgcctcagcctcccaaagcgctgggattacagatgtgagccaccgtgcccggccacaagtgttatatcttaacgagtgatctttcttgtgattatgtagtaagtagctcaggcgacatttatgcatttgatgttctttaaaatctttgttaataatgtaggttgttgtgtttttcctcaggcgatgtcattccctagtttttaaatgtatgtgaatttttagagctctttcagcagtctacagttgctctttgtgtgtatgctgcagtgatgtttgtttctgtttatagaggatcttatgtctctccttgatgccgacattcattctgcccacccaagtgtcattattgatgcagatgccatgttttctgaagacattagctattttggttacccttcttttcgtcgttcatcactttccaggctaggctcatctcgagttctccttcttcccttagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggatggaacaaaattcatctgtattggggctctgtattctgaacttctggctgtcagcagtaaaggagaactttatcagtggaaatggagtgaatctgagccttacagaaatgcccagaatccttcattacatcatccacgagcaacatttttggggttaaccaatgaaaagatagtcctcctgtctgcaaatagcataagagcaactgtagctacagaaaataacaaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggggtgtagttccttttagtcaaaggaagaaaatgttagagaaagctagagcaaaaaataaaaagcctaaatccagtgctggtatttcttcaatgccgaacatcactgttggtacccaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccacgtgtagtgatgcatcctcaattgccagcagtgcatcaatgccatacaaacgacgacggtcaacccctgcaccaaaagaagaggaaaaggtgaatgaagagcagtggtctcttcgggaagtggtttttgtggaagatgtcaagaatgttcctgttggcaaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggttgtcaaaactggtggaacaccgaaggttcccgactgtttccaaaggactcctaaaaagctttgtatacctgaaaaaacagaaatattagcagtgaatgtagattccaaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaacttctttctgccaaggatgcaagagggatgaccccatttatgtcagctgtaagtggccgagcttatcctgctgcaattaccatcttagaaactgctcagaaaattgcaaaagctgaaatatcctcaagtgaaaaagaggaagatgtattcatgggaatggtttgcccatcaggtaccaaccctgatgactctcctttatatgttttatgttgtaatgacacttgcagttttacatggactggagcagagcacattaaccaggatatttttgagtgtcgaacttgtggcttgctggagtcactgtgttgttgtacggaatgtgcaagggtttgtcataaaggtcatgattgcaaactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggggagagcacctcttactattcttagtacagacagtcgcaaggcagacggtggagcattgtcaatacaggccacctcgaatcagggaagatcgtaaccgaaaaacagccagtcctgaagattcagatatgccagatcatgatttagagcctccaagatttgcccagcttgcattggagcgtgttctacaggactggaatgccttgaaatctatgattatgtttgggtcgcaggagaataaagaccctcttagtgccagcagtagaataggccatcttttgccagaagagcaagtatacctcaatcagcaaagtggcacaattcggctggactgtttcactcattgccttatagttaagtgtacagcagatattttgcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaacaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcagctccagtcagtctcagtcatcctacatcatcaggaatccacagcagaggcgcatcagccagtcacagcccgttcggggcagagatgaagaacaggatgatattgtttcagcagatgtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaaagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagtttttatttatgtagttgtacatttttaaactaagggcaatacactgacatggttatgtgcataaaaattttgacttaaagaactggaagtttatatacacctggactataagaaacagaagaaaatcagtccacattttacagttagcagagaatcctaaatggcactggcctggccaccttttcattttacaaatgggggaagtgaagtgtgaccccttacttggcataggaagttaacttacacctaataactgacaggtttttgttttgatgacctattaattatgtagcctaggattaatatcccaaaattactctggtttaagtagctttattcagtggcataataacactgttttcttccttaagtcttcaatgaagtgacttaaaacagtcactttacatattaaaaatgaggagagcaattctctggaatctctcctttcagttcctttgtaggatttctggccttgaggatagtcttcatgttcaaaggcactatgcttttattatataacttccttcagaagactgaaccacatgatattctcagccctgttaacactaaaaatatttaaaactgaatgatagtagtgactcattgtattacttaaaacttatataacacgctgtattagatgtgtgtaaattagccaaaggttattttacaaagtgagacattggtttttatgtctaaatgctatttctgaataaatgaaatagtaattagatcaagagctgattagcatcaatgtgtttgaaagatataaaatttatacatcaccttaacctctgtatgcacatgatgggattgataaaatattaaatgagaacaaactagatatgattaggacatttgaaaccctaattgtgaatttatttttaatagttactgaaatgaaaatatttaaaataatgcacaatgtcttaagtcttcctaaatcaagattttggttaaaaaatacttctaataatagtaaaagattttttttttaagtaaatcataaaacggttctaaatgtaaaataaagacatgtaaaataaagttctcttttggtcttgtttagtgtttaaatctaacaattgaaaacaaatttaggaagagaag

SEQ ID NO: 300593 - DNA, 3177 bp, Homo sapiens
tggagacagtcttgctttgtcgccctggccagagcatatgagccaagaccatgccattgcactccagcctgggcgacagagcgagactccatctcaaaaaataaataagtaaataaataaataagctgggtgtggtggtgagcacctgtaatcccagctactcgagaggctgaggcagggagaattgcttaaacccgggagacagaggttgcagtgagctgagattgcgccactgcactccagcctatgtgacagagcgagcctctgtctcaaaaaaaaagaaaaaaaaagggaagataggtcacatttatgctgtagtttctatcctggggctaatctgatacccagtttgaaactttgaagtgtttattattttagatgaaaagttgtatttttttcttcctaatgagttaggaatttagattagatacactcctagagatgtataagctggtaggctgggcactagagctaaacagccacttctagagccttttaatggtccaagccaaagactgttgagagaactgtattttctttgctgatgctcttttcttctctggattttatgtactgttcgtttattcctctgccctgtctctggagctactgcatactggtatagcttagtccattataggaaaaatcaagaacaatgtacatttttgggtgaaaagatttttgtgagtatatgttaagagttgcgtatttagtcatgttttctgttgaatgcaaccaatgtacaatattgacagctttcacctggctttctggagtaaacagtgaatttattggtgttctagaatcattaaattcgctagagaatttgctagtgaatttggattgctttctgaacatttttctgttcttctgtagtgctccctctgagcattgtagaagtgttccagcacccctatgaagaccacattcattttgtcagggagcctttagtccactatcttgaatcatacatgaaggatctagtgatacacttttttaaagatttgtattaccaacttctctgctcatactgcattagtactagcaggtgcattggatatttattgactccaaaacttgaatgtattttgtaagtaagtccttttaaatttaaattatacgctaaattctagaagtctccgttatctggaatgtgaaaggctttttgtttttagggaaaatggagctgatagtatcctggatcttggattagtagactcctcagaaaaggtacagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagta

SEQ ID NO: 300594 - DNA, 3918 bp, Homo sapiens
cattatatttattgtatcttcatttgaacaaattattactacttttggagcagactttatctgttagcaagctgtagttggaacacattaatgctgattagtattgcaggaagaattttattttgaatgttctatcaagagtttttctttatatgatatgaaacacaaattagttatgttttttgtctttatgcataactgtatgtacacattttatagtgaaagaataacagaaaactattatttcttccagcaagtcctcagccttaaacataggtatatttttctctaccctacccccttctttttttctaccctaaataaaagatatttctggctctctgatgaagaaaaaaatatggaaattgagtatatgtatgtttaactcagagatataaaaaaacctaaaaagaaaacttgtcatacaaatattataagtagccttaacaagatgtggtactgcatggactgtttattccctgccaagtttctctataattgatcttccagtttcataaaagaccttactggttctgaaattttgtatttgttacccaagtttcttattttattttttttttaaataaaagattgtagatgtaattagacaagaggttttagagagtagtcaagtaacatttgttcatcatttacaggcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagtttttatttatgtagttgtacatttttaaactaagggcaatacactgacatggttatgtgcataaaaattttgacttaaagaactggaagtttatatacacctggactataagaaacagaagaaaatcagtccacattttacagttagcagagaatcctaaatggcactggcctggccaccttttcattttacaaatgggggaagtgaagtgtgaccccttacttggcataggaagttaacttacacctaataactgacaggtttttgttttgatgacctattaattatgtagcctaggattaatatcccaaaattactctggtttaagtagctttattcagtggcataataacactgttttcttccttaagtcttcaatgaagtgacttaaaacagtcactttacatattaaaaatgaggagagcaattctctggaatctctcctttcagttcctttgtaggatttctggccttgaggatagtcttcatgttcaaaggcactatgcttttattatataacttccttcagaagactgaaccacatgatattctcagccctgttaacactaaaaatatttaaaactgaatgatagtagtgactcattgtattacttaaaacttatataacacgctgtattagatgtgtgtaaattagccaaaggttattttacaaagtgagacattggtttttatgtctaaatgctatttctgaataaatgaaatagtaattagatcaagagctgattagcatcaatgtgtttgaaagatataaaatttatacatcaccttaacctctgtatgcacatgatgggattgataaaatattaaatgagaacaaactagatatgattaggacatttgaaaccctaattgtgaatttatttttaatagttactgaaatgaaaatatttaaaataatgcacaatgtcttaagtcttcctaaatcaagattttggttaaaaaatacttctaataatagtaaaagattttttttttaagtaaatcataaaacggttctaaatgtaaaataaagacatgtaaaataaagttctcttttggtcttgtttagtgtttaaatctaacaattgaaaacaaatttaggaagagaag

SEQ ID NO: 300595 - DNA, 2603 bp, Homo sapiens
tttagggttctactactttgtacgacagcgcgcactgtgtgggtacactctgaattcggccattatggcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagtttttatttatgtagttgtacatttttaaactaagggcaatacactgacatggttatgtgcataaaaattttgacttaaagaactggaagtttatatacacctggactataagaaacagaagaaaatcagtccacattttacagttagcagagaatcctaaatggcactggcctggccaccttttcattttacaaatgggggaagtgaagtgtgaccccttacttggcataggaagttaacttacacctaataactgacaggtttttgttttgatgacctattaattatgtagcctaggattaatatcccaaaattactctggtttaagtagctttattcagtggcataataacactgttttcttccttaagtcttcaatgaagtgacttaaaacagtcactttacatattaaaaatgaggagagcaattctctggaatctctcctttcagttcctttgtaggatttctggccttgaggatagtcttcatgttcaaaggcactatgcttttattatataacttccttcagaagactgaaccacatgatattctcagccctgttaacactaaaaatatttaaaactgaatgatagtagtgactcattgtattacttaaaacttatataacacgctgtattagatgtgtgtaaattagccaaaggttattttacaaagtgagacattggtttttatgtctaaatgctatttctgaataaatgaaatagtaattagatcaagagctgattagcatcaatgtgtttgaaagatataaaatttatacatcaccttaacctctgtatgcacatgatgggattgataaaatattaaatgagaacaaactagatatgattaggacatttgaaaccctaattgtgaatttatttttaatagttactgaaatgaaaatatttaaaataatgcacaatgtcttaagtcttcctaaatcaagattttggttaaaaaatacttctaataatagtaaaagattttttttttaagtaaatcataaaacggttctaaatgtaaaataaagacatgtaaaataaagttctcttttggtcttgtttagtgtttaaatctaacaattgaaaacaaatttaggaagagaag

SEQ ID NO: 300596 - DNA, 2741 bp, Homo sapiens
ctgaagaatgtagctggtcaccagacttgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagaacagcccttacatgcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagtttttatttatgtagttgtacatttttaaactaagggcaatacactgacatggttatgtgcataaaaattttgacttaaagaactggaagtttatatacacctggactataagaaacagaagaaaatcagtccacattttacagttagcagagaatcctaaatggcactggcctggccaccttttcattttacaaatgggggaagtgaagtgtgaccccttacttggcataggaagttaacttacacctaataactgacaggtttttgttttgatgacctattaattatgtagcctaggattaatatcccaaaattactctggtttaagtagctttattcagtggcataataacactgttttcttccttaagtcttcaatgaagtgacttaaaacagtcactttacatattaaaaatgaggagagcaattctctggaatctctcctttcagttcctttgtaggatttctggccttgaggatagtcttcatgttcaaaggcactatgcttttattatataacttccttcagaagactgaaccacatgatattctcagccctgttaacactaaaaatatttaaaactgaatgatagtagtgactcattgtattacttaaaacttatataacacgctgtattagatgtgtgtaaattagccaaaggttattttacaaagtgagacattggtttttatgtctaaatgctatttctgaataaatgaaatagtaattagatcaagagctgattagcatcaatgtgtttgaaagatataaaatttatacatcaccttaacctctgtatgcacatgatgggattgataaaatattaaatgagaacaaactagatatgattaggacatttgaaaccctaattgtgaatttatttttaatagttactgaaatgaaaatatttaaaataatgcacaatgtcttaagtcttcctaaatcaagattttggttaaaaaatacttctaataatagtaaaagattttttttttaagtaaatcataaaacggttctaaatgtaaaataaagacatgtaaaataaagttctcttttggtcttgtttagtgtttaaatctaacaattgaaaacaaatttaggaagagaag

SEQ ID NO: 300597 - DNA, 3216 bp, Homo sapiens
caaacacttcctagattcctagaatctaggaagaataaggagtggtagtgaaagtcctcttgaaagaaaaacttttatctccagtgtttgatttgctgcaattctttcttttgaaagtcctatggtctaggaataggctttttagctgtgagctgtacattagaagctccaagaagttctctgtgaaaggattatacctatattccaagattattatgtacacaaaggtactgatttttttcccctttatttttcctattttgcaagcagcttcagccaaattatatattgtaatagtttttgtgctaccttgtaatacagtttttaatactaataagaatttgtctcatttacaaaccaaaaatttaggaaggaaaacagtatccaaataaactgcctaagatcttgccactccaagtatgatcctcagatcagtagcattggcatcatctgaaagcgttttagacaggcagaatctctggtctcccctctctgcattccccacccagtgaatgaatgagaatctgcatttcttgagatcataagaatactgacatacagatgagataaaactcatgtgaatatcagttttaaggctggtggttcatttgttttggtcatattgagtcaggattgactaatgaactgtagaggttttgcattatgcaaatgctcttaatttcttgtattaggaattagacgctcccccccaagtcttaaataatgttttaatctgtatccttttattataagaagattagtaatattctacagataataacaacaactggtatagtatattttatttacattcttcattcttaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagtttttatttatgtagttgtacatttttaaactaagggcaatacactgacatggttatgtgcataaaaattttgacttaaagaactggaagtttatatacacctggactataagaaacagaagaaaatcagtccacattttacagttagcagagaatcctaaatggcactggcctggccaccttttcattttacaaatgggggaagtgaagtgtgaccccttacttggcataggaagttaacttacacctaataactgacaggtttttgttttgatgacctattaattatgtagcctaggattaatatcccaaaattactctggtttaagtagctttattcagtggcataataacactgttttcttccttaagtcttcaatgaagtgacttaaaacagtcactttacatattaaaaatgaggagagcaattctctggaatctctcctttcagttcctttgtaggatttctggccttgaggatagtcttcatgttcaaaggcactatgcttttattatataacttccttcagaagactgaaccacatgatattctcagccctgttaacactaaaaatatttaaaactgaatgatagtagtgactcattgtattacttaaaacttatataacacgctgtattagatgtgtgtaaattagccaaaggttattttacaaagtgagacattggtttttatgtctaaatgctatttctgaataaatgaaatagtaattagatcaagagctgattagcatcaatgtgtttgaaagatataaaatttatacatcaccttaacctctgtatgcacatgatgggattgataaaatattaaatgagaacaaactagatatgattaggacatttgaaaccctaattgtgaatttatttttaatagttactgaaatgaaaatatttaaaataatgcacaatgtcttaagtcttcctaaatcaagattttggttaaaaaatacttctaataatagtaaaagattttttttttaagtaaatcataaaacggttctaaatgtaaaataaagacatgtaaaataaagttctcttttggtcttgtttagtgtttaaatctaacaattgaaaacaaatttaggaagagaag

SEQ ID NO: 300598 - DNA, 2618 bp, Homo sapiens
caaacacttcctagattcctagaatctaggaagaataaggagtggtagtgaaagtcctcttgaaagaaaaacttttatctccagtgtttgatttgctgcaattctttcttttgaaagtcctatggtctaggaataggctttttagctgtgagctgtacattagaagctccaagaagttctctgtgaaaggattatacctatattccaagattattatgtacacaaaggagaaaatgctgagaagcttctgcagttcaagcgttggttctggtcaatagtagagaagatgagcatgacagaacgacaagatcttgtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagtttttatttatgtagttgtacatttttaaactaagggcaatacactgacatggttatgtgcataaaaattttgacttaaagaactggaagtttatatacacctggactataagaaacagaagaaaatcagtccacattttacagttagcagagaatcctaaatggcactggcctggccaccttttcattttacaaatgggggaagtgaagtgtgaccccttacttggcataggaagttaacttacacctaataactgacaggtttttgttttgatgacctattaattatgtagcctaggattaatatcccaaaattactctggtttaagtagctttattcagtggcataataacactgttttcttccttaagtcttcaatgaagtgacttaaaacagtcactttacatattaaaaatgaggagagcaattctctggaatctctcctttcagttcctttgtaggatttctggccttgaggatagtcttcatgttcaaaggcactatgcttttattatataacttccttcagaagactgaaccacatgatattctcagccctgttaacactaaaaatatttaaaactgaatgatagtagtgactcattgtattacttaaaacttatataacacgctgtattagatgtgtgtaaattagccaaaggttattttacaaagtgagacattggtttttatgtctaaatgctatttctgaataaatgaaatagtaattagatcaagagctgattagcatcaatgtgtttgaaagatataaaatttatacatcaccttaacctctgtatgcacatgatgggattgataaaatattaaatgagaacaaactagatatgattaggacatttgaaaccctaattgtgaatttatttttaatagttactgaaatgaaaatatttaaaataatgcacaatgtcttaagtcttcctaaatcaagattttggttaaaaaatacttctaataatagtaaaagattttttttttaagtaaatcataaaacggttctaaatgtaaaataaagacatgtaaaataaagttctcttttggtcttgtttagtgtttaaatctaacaattgaaaacaaatttaggaagagaag

SEQ ID NO: 300599 - DNA, 3592 bp, Homo sapiens
agtcatccttcacatattgtttggtttcatcctgatgcatctagaggacataagaatggggtttctgaaacagttctcccatgaattaattagtcctgcaacttatagggtttccagagttattgggtaaactacagtttatttccctcttggagtgttataattcactagtaaaagtatttctcttccaacttcttagagatccagcagtgaggtcatctaccctggttaaccacattcatccttggagaaacactttatattaagcttgtttcttatctatgaaatgagtggtttagatcaacttcatctctagagtacctgttttctatttcttttcagattttatagatcctgatacttaactttttttttttttttctgtccctttatatagaattctagatgagctttcccatacaactgtgcttcaggaaatcttaagtttgtttaggtttcctagtcattctaggaaattggatatacttcattgttgtgcattataaaatgattagattaaaaaaaaagcttttccttaagagagacagacactgaagaatgatgcgtatgtatgaagggatggattgatgaggaatgttacatgttcagcaaactatttcagggaggcatatccttggttaagttaaaaagtgtaagttcacatttactgagcatcatttacactgtgttgcacaaagttttattacagaggtatgataaaacttagtgttaatatggcttattgcatgaattttgatgcatagatagatgttccccaataattactattataaaatgattctgtatcacaatgtagcagtaaatactttttttgctttattattttattatttgcattattttgctccttaatgcaaaataactttttaagataacctgtgtgagttttgaacctaagaccgtatcttttgtttggcagccttttttccactaatagacactttatggaattagctgcaagaaaggctcttagaaaccatttagtccaacagcctcatgttacagatgaaaatactgaggctctgtgacagaaagtcacctttttttcctctactaactctagacttactcctttggggaaaaaaaacaaaaacaaaaacctgtcttgaggtatgaatgatccctttcctttttagtacaagaaaatatatttaaaatccagttcaaaataatatctccttttaggttattaacataacaatagggctttgtgtatatactgccagagttaagagttaaatattaacctgttaaattcctgttcaggtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagtttttatttatgtagttgtacatttttaaactaagggcaatacactgacatggttatgtgcataaaaattttgacttaaagaactggaagtttatatacacctggactataagaaacagaagaaaatcagtccacattttacagttagcagagaatcctaaatggcactggcctggccaccttttcattttacaaatgggggaagtgaagtgtgaccccttacttggcataggaagttaacttacacctaataactgacaggtttttgttttgatgacctattaattatgtagcctaggattaatatcccaaaattactctggtttaagtagctttattcagtggcataataacactgttttcttccttaagtcttcaatgaagtgacttaaaacagtcactttacatattaaaaatgaggagagcaattctctggaatctctcctttcagttcctttgtaggatttctggccttgaggatagtcttcatgttcaaaggcactatgcttttattatataacttccttcagaagactgaaccacatgatattctcagccctgttaacactaaaaatatttaaaactgaatgatagtagtgactcattgtattacttaaaacttatataacacgctgtattagatgtgtgtaaattagccaaaggttattttacaaagtgagacattggtttttatgtctaaatgctatttctgaataaatgaaatagtaattagatcaagagctgattagcatcaatgtgtttgaaagatataaaatttatacatcaccttaacctctgtatgcacatgatgggattgataaaatattaaatgagaacaaactagatatgattaggacatttgaaaccctaattgtgaatttatttttaatagttactgaaatgaaaatatttaaaataatgcacaatgtcttaagtcttcctaaatcaagattttggttaaaaaatacttctaataatagtaaaagattttttttttaagtaaatcataaaacggttctaaatgtaaaataaagacatgtaaaataaagttctcttttggtcttgtttagtgtttaaatctaacaattgaaaacaaatttaggaagagaag

SEQ ID NO: 300600 - DNA, 2361 bp, Homo sapiens
  misc_feature (30)..(30): n is a, c, g, or t
tcacgacacgacaaacggtcgagcaatacnaaaaagcaccaccacaccaaccgctggtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagtttttatttatgtagttgtacatttttaaactaagggcaatacactgacatggttatgtgcataaaaattttgacttaaagaactggaagtttatatacacctggactataagaaacagaagaaaatcagtccacattttacagttagcagagaatcctaaatggcactggcctggccaccttttcattttacaaatgggggaagtgaagtgtgaccccttacttggcataggaagttaacttacacctaataactgacaggtttttgttttgatgacctattaattatgtagcctaggattaatatcccaaaattactctggtttaagtagctttattcagtggcataataacactgttttcttccttaagtcttcaatgaagtgacttaaaacagtcactttacatattaaaaatgaggagagcaattctctggaatctctcctttcagttcctttgtaggatttctggccttgaggatagtcttcatgttcaaaggcactatgcttttattatataacttccttcagaagactgaaccacatgatattctcagccctgttaacactaaaaatatttaaaactgaatgatagtagtgactcattgtattacttaaaacttatataacacgctgtattagatgtgtgtaaattagccaaaggttattttacaaagtgagacattggtttttatgtctaaatgctatttctgaataaatgaaatagtaattagatcaagagctgattagcatcaatgtgtttgaaagatataaaatttatacatcaccttaacctctgtatgcacatgatgggattgataaaatattaaatgagaacaaactagatatgattaggacatttgaaaccctaattgtgaatttatttttaatagttactgaaatgaaaatatttaaaataatgcacaatgtcttaagtcttcctaaatcaagattttggttaaaaaatacttctaataatagtaaaagattttttttttaagtaaatcataaaacggttctaaatgtaaaataaagacatgtaaaataaagttctcttttggtcttgtttagtgtttaaatctaacaattgaaaacaaatttaggaagagaag

SEQ ID NO: 300601 - DNA, 7541 bp, Homo sapiens
atccgcctgcctcagcctcccaaagcgctgggattacagatgtgagccaccgtgcccggccacaagtgttatatcttaacgagtgatctttcttgtgattatgtagtaagtagctcaggcgacatttatgcatttgatgttctttaaaatctttgttaataatgtaggttgttgtgtttttcctcaggcgatgtcattccctagtttttaaatgtatgtgaatttttagagctctttcagcagtctacagttgctctttgtgtgtatgctgcagtgatgtttgtttctgtttatagaggatcttatgtctctccttgatgccgacattcattctgcccacccaagtgtcattattgatgcagatgccatgttttctgaagacattagctattttggttacccttcttttcgtcgttcatcactttccaggctaggctcatctcgagttctccttcttcccttagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggatggaacaaaattcatctgtattggggctctgtattctgaacttctggctgtcagcagtaaaggagaactttatcagtggaaatggagtgaatctgagccttacagaaatgcccagaatccttcattacatcatccacgagcaacatttttggggttaaccaatgaaaagatagtcctcctgtctgcaaatagcataagagcaactgtagctacagaaaataacaaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggggtgtagttccttttagtcaaaggaagaaaatgttagagaaagctagagcaaaaaataaaaagcctaaatccagtgctggtatttcttcaatgccgaacatcactgttggtacccaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccacgtgtagtgatgcatcctcaattgccagcagtgcatcaatgccatacaaacgacgacggtcaacccctgcaccaaaagaagaggaaaaggtgaatgaagagcagtggtctcttcgggaagtggtttttgtggaagatgtcaagaatgttcctgttggcaaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggttgtcaaaactggtggaacaccgaaggttcccgactgtttccaaaggactcctaaaaagctttgtatacctgaaaaaacagaaatattagcagtgaatgtagattccaaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaacttctttctgccaaggatgcaagagggatgaccccatttatgtcagctgtaagtggccgagcttatcctgctgcaattaccatcttagaaactgctcagaaaattgcaaaagctgaaatatcctcaagtgaaaaagaggaagatgtattcatgggaatggtttgcccatcaggtaccaaccctgatgactctcctttatatgttttatgttgtaatgacacttgcagttttacatggactggagcagagcacattaaccaggatatttttgagtgtcgaacttgtggcttgctggagtcactgtgttgttgtacggaatgtgcaagggtttgtcataaaggtcatgattgcaaactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggggagagcacctcttactattcttagtacagacagtcgcaaggcagacggtggagcattgtcaatacaggccacctcgaatcagggaagatcgtaaccgaaaaacagccagtcctgaagattcagatatgccagatcatgatttagagcctccaagatttgcccagcttgcattggagcgtgttctacaggactggaatgccttgaaatctatgattatgtttgggtcgcaggagaataaagaccctcttagtgccagcagtagaataggccatcttttgccagaagagcaagtatacctcaatcagcaaagtggcacaattcggctggactgtttcactcattgccttatagttaagtgtacagcagatattttgcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaacaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcagctccagtcagtctcagtcatcctacatcatcaggaatccacagcagaggcgcatcagccagtcacagcccgttcggggcagagatgaagaacaggatgatattgtttcagcagatgtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggatagagactttagaagacagctttccatcgacactaggccctttagaccagcctctgaagggaatcctagcgatgatcctgagcctttgccagcacatcggcaggcacttggagagaggctttatcctcgtgtacaagcaatgcaaccagcatttgcaagtaaaatcactggcatgttgttggaattatccccagctcagctgcttctccttctagcaagtgaggattctctgagagcaagagtggatgaggccatggaactcattattgcacatggacgggaaaatggagctgatagtatcctggatcttggattagtagactcctcagaaaaggtacagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggattcttggactatgtctgttacagaatgaactatgtcctatcacattgaatagacatgtaattaaagtattgcttggtagaaaagtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggttgaactcattcctaatggtgtaaatataccagtcactccacagaatgtatatgagtatgtgcggaaatacgcagaacacagaatgttggtagttgcagaacagcccttacatgtaagtgtttctagaaagtgttgtg

SEQ ID NO: 300602 - DNA, 6934 bp, Homo sapiens
atccgcctgcctcagcctcccaaagcgctgggattacagatgtgagccaccgtgcccggccacaagtgttatatcttaacgagtgatctttcttgtgattatgtagtaagtagctcaggcgacatttatgcatttgatgttctttaaaatctttgttaataatgtaggttgttgtgtttttcctcaggcgatgtcattccctagtttttaaatgtatgtgaatttttagagctctttcagcagtctacagttgctctttgtgtgtatgctgcagtgatgtttgtttctgtttatagaggatcttatgtctctccttgatgccgacattcattctgcccacccaagtgtcattattgatgcagatgccatgttttctgaagacattagctattttggttacccttcttttcgtcgttcatcactttccaggctaggctcatctcgagttctccttcttcccttagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggatggaacaaaattcatctgtattggggctctgtattctgaacttctggctgtcagcagtaaaggagaactttatcagtggaaatggagtgaatctgagccttacagaaatgcccagaatccttcattacatcatccacgagcaacatttttggggttaaccaatgaaaagatagtcctcctgtctgcaaatagcataagagcaactgtagctacagaaaataacaaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggggtgtagttccttttagtcaaaggaagaaaatgttagagaaagctagagcaaaaaataaaaagcctaaatccagtgctggtatttcttcaatgccgaacatcactgttggtacccaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagcctgaaagtaagcaggagccagtgaaaacagaaatgggtcctccaccatctccagcatccacgtgtagtgatgcatcctcaattgccagcagtgcatcaatgccatacaaacgacgacggtcaacccctgcaccaaaagaagaggaaaaggtgaatgaagagcagtggtctcttcgggaagtggtttttgtggaagatgtcaagaatgttcctgttggcaaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggttgtcaaaactggtggaacaccgaaggttcccgactgtttccaaaggactcctaaaaagctttgtatacctgaaaaaacagaaatattagcagtgaatgtagattccaaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagaggaagcggagcgttctgaaagaaatacatttgcagaaaggctttctgctgttgaggccattgcaaatgcaatatcagttgtttcaagtaatggcccaggtaatcgggctggatcatcaagtagccgaagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctgatggtgacattgattttatcctggcccccgctgtgggatctcttaccacagcagcaaccggtactggtcaaggaccaagcacctccactattccaggtccttccacagagccatctgtagtagaatccaaggatcgaaaggcgaatgctcattttatattgaaattgttatgtgacagtgtggttctccagccctatctacgagaacttctttctgccaaggatgcaagagggatgaccccatttatgtcagctgtaagtggccgagcttatcctgctgcaattaccatcttagaaactgctcagaaaattgcaaaagctgaaatatcctcaagtgaaaaagaggaagatgtattcatgggaatggtttgcccatcaggtaccaaccctgatgactctcctttatatgttttatgttgtaatgacacttgcagttttacatggactggagcagagcacattaaccaggatatttttgagtgtcgaacttgtggcttgctggagtcactgtgttgttgtacggaatgtgcaagggtttgtcataaaggtcatgattgcaaactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggggagagcacctcttactattcttagtacagacagtcgcaaggcagacggtggagcattgtcaatacaggccacctcgaatcagggaagatcgtaaccgaaaaacagccagtcctgaagattcagatatgccagatcatgatttagagcctccaagatttgcccagcttgcattggagcgtgttctacaggactggaatgccttgaaatctatgattatgtttgggtcgcaggagaataaagaccctcttagtgccagcagtagaataggccatcttttgccagaagagcaagtatacctcaatcagcaaagtggcacaattcggctggactgtttcactcattgccttatagttaagtgtacagcagatattttgcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaacaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcagctccagtcagtctcagtcatcctacatcatcaggaatccacagcagaggcgcatcagccagtcacagcccgttcggggcagagatgaagaacaggatgatattgtttcagcagatgtggaagaggttgaggtggtggagggtgtggctggagaagaggatcatcatgatgaacaggaagaacacggggaagaaaatgctgaggcagagggacaacatgatgagcatgatgaagacgggagtgatatggagctggacttgttagcagcagctgaaacagaaagtgatagtgaaagtaaccacagcaaccaagataatgctagtgggcgcagaagcgttgtcactgcagcaactgctggttcagaagcaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacgacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggacgcgagaactcttggaactgggtattgataatgaagattcagaacatgaaaatgatgatgacaccaatcaaagtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcagccaaatgctagaaaggaggatctttttggccgtccaagtcagggtctttattcttcatctgccagtagtgggaaatgtttaatggaggttacagtggatagaaactgcctagaggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggccacagtgtagctttatgggaatggttatttcccatgatatgctgctaggacgttggcgcctttctttagaactgttcggcagggtattcatggaagatgttggagcagaacctggatcaatcctaactgaattgggtggttttgaggtaaaagaatcaaaattccgcagagaaatggaaaaactgagaaaccagcagtcaagagatttgtcactagaggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtttaatgcagagattaaggaaccgaggagagagagaccgggaaagggagagagaaagggaaatgaggaggagtagtggtttgcgagcaggttctcggagggaccgggataggtaaattttgtatctttgattcaataccacctttttggatgaattagagataggcctgtaaatgaaagaatcttaattatggattattttttagaaaagtaaagttttaattttgaacatatgtatagtaactaagaatagtctgttaataaaatacaataactaagaatagtctattaactaataaaaagttctgctttaaaaacccagaggcggttgaaattatattctttttatctgactcaagttcctatttgaatttttttacccatatcattctctcctaagt

SEQ ID NO: 300603 - DNA, 368 bp, Homo sapiens
aaggccagtgtgaatggaggtgagtgagttaatggagggagccagggccaccttaattggataccttgtaggctgtgctaaagacttcgtatagttgtggtttatgtgtttacataattaatctagatctgatgaagtgattaaagtgacagtgttcaaatcagtagatttggcaatttttatatttatagtattgtattttactttataggatggaacaaaattcatctgtattggggctctgtattctgaacttctggctgtcagcagtaaaggagaactttatcagtggaaatggagtgaatctgagccttacagaaatgcccaggtattttattttatgaaatcttgcattgaatagctctaca

SEQ ID NO: 300604 - DNA, 240 bp, Homo sapiens
gtttaaaatgctaattttataaattctccaatatttagaagccgctggagttctggagtgggtggaagtggtggaggatcctctggtaggtcatcagctggagctcgagattcccgccggcagactcgagttattcggacaggacgggatcgagggtctgggcttttgggcagtcagccccagccagttattccagcatctgtcattccagaggagctgatttcacaggtatggatctcg

SEQ ID NO: 300605 - DNA, 397 bp, Homo sapiens
tcttagtgccagcagtagaataggccatcttttgccagaagagcaagtatacctcaatcagcaaagtggcacaattcggctggactgtttcactcattgccttatagttaagtgtacagcagatattttggtaagttctttgaatgtgtattacaagtacatgaaaagtatgtttttcaagtactcttctttgctgtgaaactagaaaagaatttaaaccttaagatccagtgcgaatgaggttatggtaataacacactcagatagggatggggtggcattgcatcgttcctttctctggaaaacataaaactatcagtgccctcagaacctgtcataaataaataatttacgatgtgagaaaaataaaggcatgtcacagaataatgtaaaattt

SEQ ID NO: 300606 - DNA, 667 bp, Homo sapiens
taaattctccaatatttagaagccgctggagttctggagtgggtggaagtggtggaggatcctctggtaggtcatcagctggagctcgagattcccgccggcagactcgagttattcggacaggacgggatcgagggtctgggcttttgggcagtcagccccagccagttattccagcatctgtcattccagaggagctgatttcacaggtatggatctcgtagaacacttaatgtcagacaacaggacaaggtgaggttttactgaatatggtgggttgtagtcatgactcatatcatgagttctgaaacaactgttttcctattttgatcctagaaaactttttttttttcctttgagagggagtctcactctgctgcccaggctggagtacagtggcatgatctcagctcactgcaacctccgtcccctgagttcaagcaattctcatgcctcagcctcccgagtagctggaattaatgggtgtgcaccaccacacccagctaatttttgtattttttagtagagacggggtttcaccatgttagccaggctggtcttgaactactgacctcaggtgatccgcccaccttggcctcccgaagtgctgggattacaggcttgagccaccacatcctgtcctagaaagctgattttgataaagaat

SEQ ID NO: 300607 - DNA, 394 bp, Homo sapiens
ttggactttaaggagaggaggtaaaatgaaagacgaagataagacatagcccagggatttatccgtatgtagaatacagaaggaataagggaggaaaaataataagttgtcgggaacaagtagctatggaaaagttctctgttaggacacagtttgaagaagttaagacctcagaatatttttttaaaaaagtaagttactaccattgaacaaaaaccaatcagtctttgaaattggctaaattatttctcccccccaccccttcccttaaacttcttacaggccacagtgtagctttatgggaatggttatttcccatgatatgctgctaggacgttggcgcctttctttagaactgttcggcagggtattcatggaagatgttggagcagaa

SEQ ID NO: 300608 - DNA, 679 bp, Homo sapiens
gtattcaatgtaactagaatatttctgttaaaattccagccaaatgctagaaaggaggatctttttggccgtccaagtcagggtctttattcttcatctgccagtagtgggaaatgtttaatggaggttacagtggatagaaactgcctagaggtaagacagtaaaagtttttttgcaatataacatttattaaggacaacttgtcccagcatatagatttttagaaatgcgttaattcagaatattatattttctgaaatgaagtgtcagaaattcctgccttgtggtataatgtaggaagaattccaacactgtcattaacttgctgtcagatcacttcatccataaaataccagcctccatatgtgctttgtctgtttcacagagctgactgctgtatgtggctgaaaatttgaatttttcatgtataataaaaatatatagatgagcatgtgtaattttggctacaacttttacttgctgaactaattttaatcaagactgtagataaatagcattaataatgatacctaatatttgttgactaattctgtttcctgggcattggtctccatctttataactatgtttggtagaatgcattatcaccctgattttttgggtgagaaatagagtcttgaagagagtaagtaaatttcacgtgggaatgtctgtgtc

SEQ ID NO: 300609 - DNA, 365 bp, Homo sapiens
tgactttgaaatttaaggtagttgaatttgcattcatctaaatacagtatatttctgattttcttctaggtttaatgcagagattaaggaaccgaggagagagagaccgggaaagggagagagaaagggaaatgaggaggagtagtggtttgcgagcaggttctcggagggaccgggataggtaaattttgtatctttgattcaataccacctttttggatgaattagagataggcctgtaaatgaaagaatcttaattatggattattttttagaaaagtaaagttttaattttgaacatatgtatagtaactaagaatagtctgttaataaaatacaataactaagaatagtctattaactaa

SEQ ID NO: 300610 - DNA, 4511 bp, Homo sapiens
caattgtcatacgacttgcagtgagcgtcaggagcacgtccaggaactcctcagcagcgcctccttcagctccacagccagacgccctcagacagcaaagcctacccccgcgccgcgccctgcccgccgctgcgatgctcgcccgcgccctgctgctgtgcgcggtcctggcgctcagccatacagcaaatccttgctgttcccacccatgtcaaaaccgaggtgtatgtatgagtgtgggatttgaccagtataagtgcgattgtacccggacaggattctatggagaaaactgctcaacaccggaatttttgacaagaataaaattatttctgaaacccactccaaacacagtgcactacatacttacccacttcaagggattttggaacgttgtgaataacattcccttccttcgaaatgcaattatgagttatgtgttgacatccagatcacatttgattgacagtccaccaacttacaatgctgactatggctacaaaagctgggaagccttctctaacctctcctattatactagagcccttcctcctgtgcctgatgattgcccgactcccttgggtgtcaaaggtaaaaagcagcttcctgattcaaatgagattgtggaaaaattgcttctaagaagaaagttcatccctgatccccagggctcaaacatgatgtttgcattctttgcccagcacttcacgcatcagtttttcaagacagatcataagcgagggccagctttcaccaacgggctgggccatggggtggacttaaatcatatttacggtgaaactctggctagacagcgtaaactgcgccttttcaaggatggaaaaatgaaatatcagataattgatggagagatgtatcctcccacagtcaaagatactcaggcagagatgatctaccctcctcaagtccctgagcatctacggtttgctgtggggcaggaggtctttggtctggtgcctggtctgatgatgtatgccacaatctggctgcgggaacacaacagagtatgcgatgtgcttaaacaggagcatcctgaatggggtgatgagcagttgttccagacaagcaggctaatactgataggagagactattaagattgtgattgaagattatgtgcaacacttgagtggctatcacttcaaactgaaatttgacccagaactacttttcaacaaacaattccagtaccaaaatcgtattgctgctgaatttaacaccctctatcactggcatccccttctgcctgacacctttcaaattcatgaccagaaatacaactatcaacagtttatctacaacaactctatattgctggaacatggaattacccagtttgttgaatcattcaccaggcaaattgctggcagggttgctggtggtaggaatgttccacccgcagtacagaaagtatcacaggcttccattgaccagagcaggcagatgaaataccagtcttttaatgagtaccgcaaacgctttatgctgaagccctatgaatcatttgaagaacttacaggagaaaaggaaatgtctgcagagttggaagcactctatggtgacatcgatgctgtggagctgtatcctgcccttctggtagaaaagcctcggccagatgccatctttggtgaaaccatggtagaagttggagcaccattctccttgaaaggacttatgggtaatgttatatgttctcctgcctactggaagccaagcacttttggtggagaagtgggttttcaaatcatcaacactgcctcaattcagtctctcatctgcaataacgtgaagggctgtccctttacttcattcagtgttccagatccagagctcattaaaacagtcaccatcaatgcaagttcttcccgctccggactagatgatatcaatcccacagtactactaaaagaacgttcgactgaactgtagaagtctaatgatcatatttatttatttatatgaaccatgtctattaatttaattatttaataatatttatattaaactccttatgttacttaacatcttctgtaacagaagtcagtactcctgttgcggagaaaggagtcatacttgtgaagacttttatgtcactactctaaagattttgctgttgctgttaagtttggaaaacagtttttattctgttttataaaccagagagaaatgagttttgacgtctttttacttgaatttcaacttatattataagaacgaaagtaaagatgtttgaatacttaaacactgtcacaagatggcaaaatgctgaaagtttttacactgtcgatgtttccaatgcatcttccatgatgcattagaagtaactaatgtttgaaattttaaagtacttttggttatttttctgtcatcaaacaaaaacaggtatcagtgcattattaaatgaatatttaaattagacattaccagtaatttcatgtctactttttaaaatcagcaatgaaacaataatttgaaatttctaaattcatagggtagaatcacctgtaaaagcttgtttgatttcttaaagttattaaacttgtacatataccaaaaagaagctgtcttggatttaaatctgtaaaatcagtagaaattttactacaattgcttgttaaaatattttataagtgatgttcctttttcaccaagagtataaacctttttagtgtgactgttaaaacttccttttaaatcaaaatgccaaatttattaaggtggtggagccactgcagtgttatcttaaaataagaatattttgttgagatattccagaatttgtttatatggctggtaacatgtaaaatctatatcagcaaaagggtctacctttaaaataagcaataacaaagaagaaaaccaaattattgttcaaatttaggtttaaacttttgaagcaaacttttttttatccttgtgcactgcaggcctggtactcagattttgctatgaggttaatgaagtaccaagctgtgcttgaataacgatatgttttctcagattttctgttgtacagtttaatttagcagtccatatcacattgcaaaagtagcaatgacctcataaaatacctcttcaaaatgcttaaattcatttcacacattaattttatctcagtcttgaagccaattcagtaggtgcattggaatcaagcctggctacctgcatgctgttccttttcttttcttcttttagccattttgctaagagacacagtcttctcatcacttcgtttctcctattttgttttactagttttaagatcagagttcactttctttggactctgcctatattttcttacctgaacttttgcaagttttcaggtaaacctcagctcaggactgctatttagctcctcttaagaagattaaaagagaaaaaaaaaggcccttttaaaaatagtatacacttattttaagtgaaaagcagagaattttatttatagctaattttagctatctgtaaccaagatggatgcaaagaggctagtgcctcagagagaactgtacggggtttgtgactggaaaaagttacgttcccattctaattaatgccctttcttatttaaaaacaaaaccaaatgatatctaagtagttctcagcaataataataatgacgataatacttcttttccacatctcattgtcactgacatttaatggtactgtatattacttaatttattgaagattattatttatgtcttattaggacactatggttataaactgtgtttaagcctacaatcattgatttttttttgttatgtcacaatcagtatattttctttggggttacctctctgaatattatgtaaacaatccaaagaaatgattgtattaagatttgtgaataaatttttagaaatctgattggcatattgagatatttaaggttgaatgtttgtccttaggataggcctatgtgctagcccacaaagaatattgtctcattagcctgaatgtgccataagactgaccttttaaaatgttttgagggatctgtggatgcttcgttaatttgttcagccacaatttattgagaaaatattctgtgtcaagcactgtgggttttaatatttttaaatcaaacgctgattacagataatagtatttatataaataattgaaaaaaattttcttttgggaagagggagaaaatgaaataaatatcattaaagataactcaggagaatcttctttacaattttacgtttagaatgtttaaggttaagaaagaaatagtcaatatgcttgtataaaacactgttcactgttttttttaaaaaaaaaacttgatttgttattaacattgatctgctgacaaaacctgggaatttgggttgtgtatgcgaatgtttcagtgcctcagacaaatgtgtatttaacttatgtaaaagataagtctggaaataaatgtctgtttatttttgtactatttaaaaattgacagatcttttctgaagataaactttgattgtttctata

SEQ ID NO: 300611 - DNA, 4605 bp, Homo sapiens
caattgtcatacgacttgcagtgagcgtcaggagcacgtccaggaactcctcagcagcgcctccttcagctccacagccagacgccctcagacagcaaagcctacccccgcgccgcgccctgcccgccgctgcgatgctcgcccgcgccctgctgctgtgcgcggtcctggcgctcagccatacagcaaatccttgctgttcccacccatgtcaaaaccgaggtgtatgtatgagtgtgggatttgaccagtataagtgcgattgtacccggacaggattctatggagaaaactgctcaacaccggaatttttgacaagaataaaattatttctgaaacccactccaaacacagtgcactacatacttacccacttcaagggattttggaacgttgtgaataacattcccttccttcgaaatgcaattatgagttatgtgttgacatccagatcacatttgattgacagtccaccaacttacaatgctgactatggctacaaaagctgggaagccttctctaacctctcctattatactagagcccttcctcctgtgcctgatgattgcccgactcccttgggtgtcaaaggtaaaaagcagcttcctgattcaaatgagattgtggaaaaattgcttctaagaagaaagttcatccctgatccccagggctcaaacatgatgtttgcattctttgcccagcacttcacgcatcagtttttcaagacagatcataagcgagggccagctttcaccaacgggctgggccatggggtggacttaaatcatatttacggtgaaactctggctagacagcgtaaactgcgccttttcaaggatggaaaaatgaaatatcagataattgatggagagatgtatcctcccacagtcaaagatactcaggcagagatgatctaccctcctcaagtccctgagcatctacggtttgctgtggggcaggaggtctttggtctggtgcctggtctgatgatgtatgccacaatctggctgcgggaacacaacagagtatgcgatgtgcttaaacaggagcatcctgaatggggtgatgagcagttgttccagacaagcaggctaatactgataggagagactattaagattgtgattgaagattatgtgcaacacttgagtggctatcacttcaaactgaaatttgacccagaactacttttcaacaaacaattccagtaccaaaatcgtattgctgctgaatttaacaccctctatcactggcatccccttctgcctgacacctttcaaattcatgaccagaaatacaactatcaacagtttatctacaacaactctatattgctggaacatggaattacccagtttgttgaatcattcaccaggcaaattgctggcagggttgctggtggtaggaatgttccacccgcagtacagaaagtatcacaggcttccattgaccagagcaggcagatgaaataccagtcttttaatgagtaccgcaaacgctttatgctgaagccctatgaatcatttgaagaacttacaggagaaaaggaaatgtctgcagagttggaagcactctatggtgacatcgatgctgtggagctgtatcctgcccttctggtagaaaagcctcggccagatgccatctttggtgaaaccatggtagaagttggagcaccattctccttgaaaggacttatgggtaatgttatatgttctcctgcctactggaagccaagcacttttggtggagaagtgggttttcaaatcatcaacactgcctcaattcagtctctcatctgcaataacgtgaagggctgtccctttacttcattcagtgttccagatccagagctcattaaaacagtcaccatcaatgcaagttcttcccgctccggactagatgatatcaatcccacagtactactaaaagaacgttcgactgaactgtagaagtctaatgatcatatttatttatttatatgaaccatgtctattaatttaattatttaataatatttatattaaactccttatgttacttaacatcttctgtaacagaagtcagtactcctgttgcggagaaaggagtcatacttgtgaagacttttatgtcactactctaaagattttgctgttgctgttaagtttggaaaacagtttttattctgttttataaaccagagagaaatgagttttgacgtctttttacttgaatttcaacttatattataagaacgaaagtaaagatgtttgaatacttaaacactgtcacaagatggcaaaatgctgaaagtttttacactgtcgatgtttccaatgcatcttccatgatgcattagaagtaactaatgtttgaaattttaaagtacttttggttatttttctgtcatcaaacaaaaacaggtatcagtgcattattaaatgaatatttaaattagacattaccagtaatttcatgtctactttttaaaatcagcaatgaaacaataatttgaaatttctaaattcatagggtagaatcacctgtaaaagcttgtttgatttcttaaagttattaaacttgtacatataccaaaaagaagctgtcttggatttaaatctgtaaaatcagtagaaattttactacaattgcttgttaaaatattttataagtgatgttcctttttcaccaagagtataaacctttttagtgtgactgttaaaacttccttttaaatcaaaatgccaaatttattaaggtggtggagccactgcagtgttatcttaaaataagaatattttgttgagatattccagaatttgtttatatggctggtaacatgtaaaatctatatcagcaaaagggtctacctttaaaataagcaataacaaagaagaaaaccaaattattgttcaaatttaggtttaaacttttgaagcaaacttttttttatccttgtgcactgcaggcctggtactcagattttgctatgaggttaatgaagtaccaagctgtgcttgaataacgatatgttttctcagattttctgttgtacagtttaatttagcagtccatatcacattgcaaaagtagcaatgacctcataaaatacctcttcaaaatgcttaaattcatttcacacattaattttatctcagtcttgaagccaattcagtaggtgcattggaatcaagcctggctacctgcatgctgttccttttcttttcttcttttagccattttgctaagagacacagtcttctcatcacttcgtttctcctattttgttttactagttttaagatcagagttcactttctttggactctgcctatattttcttacctgaacttttgcaagttttcaggtaaacctcagctcaggactgctatttagctcctcttaagaagattaaaagagaaaaaaaaaggcccttttaaaaatagtatacacttattttaagtgaaaagcagagaattttatttatagctaattttagctatctgtaaccaagatggatgcaaagaggctagtgcctcagagagaactgtacggggtttgtgactggaaaaagttacgttcccattctaattaatgccctttcttatttaaaaacaaaaccaaatgatatctaagtagttctcagcaataataataatgacgataatacttcttttccacatctcattgtcactgacatttaatggtactgtatattacttaatttattgaagattattatttatgtcttattaggacactatggttataaactgtgtttaagcctacaatcattgatttttttttgttatgtcacaatcagtatattttctttggggttacctctctgaatattatgtaaacaatccaaagaaatgattgtattaagatttgtgaataaatttttagaaatctgattggcatattgagatatttaaggttgaatgtttgtccttaggataggcctatgtgctagcccacaaagaatattgtctcattagcctgaatgtgccataagactgaccttttaaaatgttttgagggatctgtggatgcttcgttaatttgttcagccacaatttattgagaaaatattctgtgtcaagcactgtgggttttaatatttttaaatcaaacgctgattacagataatagtatttatataaataattgaaaaaaattttcttttgggaagagggagaaaatgaaataaatatcattaaagataactcaggagaatcttctttacaattttacgtttagaatgtttaaggttaagaaagaaatagtcaatatgcttgtataaaacactgttcactgttttttttaaaaaaaaaacttgatttgttattaacattgatctgctgacaaaacctgggaatttgggttgtgtatgcgaatgtttcagtgcctcagacaaatgtgtatttaacttatgtaaaagataagtctggaaataaatgttctgcagaaaaaaaaaaaaaaaaaaaaaaaaattttttggggggctggctggaaaaggtttaaacatttttgggggggggccatggtatttgaaatggcaaggtttccaagaaccgggcgacaaggggggtttcccaaaaaagggggccgggttgaaaccgg

SEQ ID NO: 300612 - DNA, 454 bp, Homo sapiens
ttgaattttaagcagagctcctgttgaaatgtaggtaagcatctttccagcaaataaaaattgtctccgctgggagtttcagttttacctgatttgtacctaaggcaagctgaatacaaacagtaaatatgcctaaaattcttgttttacaactaattttactttccacaggttgctggtggtaggaatgttccacccgcagtacagaaagtatcacaggcttccattgaccagagcaggcagatgaaataccagtcttttaatgagtaccgcaaacgctttatgctgaagccctatgaatcatttgaagaacttacaggtaagaaacagtttctaaacttcttcgttttttgtttgtttgtttgtttttgttgtttttggttttcttttcgagatggagccgccctctgtcacccaggctggagtgcagtggcgccatctcggctcactgcaa

SEQ ID NO: 300613 - DNA, 427 bp, Homo sapiens
tcgacctatcggtctagaccaagacgctacgtagagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaagaa

SEQ ID NO: 300614 - DNA, 410 bp, Homo sapiens
ataacgaaacttattttttatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctcatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaagacacgttgaaatgatgcaggctgctcctatgttggaaatttgttcattaaaattctcccaataaagctttacagccttctgcaaagaa

SEQ ID NO: 300615 - DNA, 449 bp, Homo sapiens
tagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaagtcttgcgcatcttttgt

SEQ ID NO: 300616 - DNA, 3782 bp, Homo sapiens
cgcccagctaatttttgtatttttggtagagacagggtttcgccatgttgcccaggctggtcttgaacttctgacctcaagtgatatgcctgcctcagcctcccaaggggtacctccccacagtcctggagcagactgtggcccctcagggccttgagtggcacgctggtggggcagctcttgtcttggagccgtcaggcaccgtgtgaaagtttggaggagggaggcaggaggtgaggttggaagttgagcaaggttccaggagtcagccggagctggggcagcatacggggttgcaagtgaagccgctgagaggcaaaagggatgagtgttagctgctgtgggattgggaagcgcaggagcttcaggaccagcttgtcttgggggtggtaaggagcctaggatgggatggttgggtgttagcagggtggaggaggcctggtgtgggcccttgtttctgcgtcaccctgtcctctgccctttccccttcctggacaggggtctctgcagttcccagaaacccagtgcccggtgcagagaagagggtggagccttgccgccccctgcccccggcctccgacccgagcccccacccgcctgtgcttgcctcccaggtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacga

SEQ ID NO: 300617 - DNA, 3538 bp, Homo sapiens
  misc_feature (47)..(47): n is a, c, g, or t
gagcgggcgcgagtcccgacgccgccccgccctctactcaccgggcnccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacga

SEQ ID NO: 300618 - DNA, 3567 bp, Homo sapiens
gggtgctctgagtgagtattgtgtgagatggccgtggctgcacgaggtgaactgacgtgatactgtgaatgaacgctgacagcacaggtgcacttggcagtgacgacggggacatagacactcttgtcgcctcggtgagatgatgtgtggtgcgcacatggtttctttcgggacacgctatatggaagcactgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacga

SEQ ID NO: 300619 - DNA, 3023 bp, Homo sapiens
ctgggccaggccctgtgcatgacgcagcccgtgtgcccccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacga

SEQ ID NO: 300620 - DNA, 2907 bp, Homo sapiens
taacacgtgtccctgtgtctgggtgaccatttttccctggatggtcagctcatgggaggggctcccagcaccaggctgcagagggcccggtggcccgaccaggatcctcacctgtctctccccgttccagcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacga

SEQ ID NO: 300621 - DNA, 6057 bp, Homo sapiens
  misc_feature (47)..(47): n is a, c, g, or t
gagcgggcgcgagtcccgacgccgccccgccctctactcaccgggcnccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacgattctgctggtcagaccttacgttctgggatgcggggtggggagcctgtattatccctgcaccccagaggctgggggtgctcctgacccagtctgcccccacactgtcctgccagagggagccctgtggctgcagaggccccaggctgggccaggcactggctgtgagggctcctgccaggtctaccccacctgtgggcagggccttgggcagaggatagaagccaccgacaggctcaaatccctgctcctgcccctgcttacccccagtaaccaagcccagcattgaggctgggtactggcgcccagtaggtctgagtctttcaggtagaaggtagaagtgtaggctgcgtgtgcagcgagtggcaccggtgagcggcgctgggaaaccggagcgtgtggaccgggccatgaggacagcgtcctcactggggtggcagttggcttggaggtcacctgggggctcgctcagctaacaggagagggtgcttgttccccgcattcgtggtggtccctcctggtcacccattgaagcagtgtttgtggtggagcccctgagggcttggtggggttgagcagaatgaggaaaggtttcatggagcagggagggagacggctagggcagcaagtgaaggacagactcgccttcccatccctccaggggcactcctgccagccagcccctctcccgcttcccatgatggggtggctgttggaattctgcaccccatctcttctgattgttggggcccaggacaaggggacaggcatttgtgggcctaacctccccaggcagataggaggaggaagccatgtcccagcaggctagggcagagggacccccagtgccaacagtgctttatcagcgggcgccaggcagggccatccccagggtgaggacaacatctccctgggccctgttatcagtcacagagtccacaggacgctccttgggttaacgtgtaaccatgagccctcccctccaccccctgaagccactcgctcccagattaggtcgctctggggctatcaggccagcatggacgctggcaaagcggggcagaccctgaagactcactgctcagcccaggtgagagccttctgagctgtgcctggggctggggggacagggccctggaaccccagcagccggcgggtctgggagctgctgtccttgagttggttgggccctgggaagctgggttctggcagcctggtccctgaatgggtccagcctgtacagctggggtcccaggtgggggtgggacaggagccatgagatctgagtcccaagaatgggggctgggctgggtttcggctcagtagctccccactccccaaagcgcccagatgtctgcaggtggctgagccccttcatcctctcctgctgcgtgtacttctgcctctggattcccgaggaccagctgtcctggttcgctgccctggtcaagtgcctgcctgtcctctgcctggctgggttcctgtgggtcatgtccccaagcgggggctacacccagctcctccagggagcccttgtgtgctcggctgtgggggacgcttgcctcatctggccggcagccttcgtccctggcatggccgcctttgccaccgccacctcctctacgtctgggccttcggcttctctcccctgcagcccggctgctgctgctcatcatcctggcccctggccctacctcagccttgtgctccagcacctcgagccggatatggtcctgccggtggcagcctatgggctgatcctgatggccatgctgtggcgcggcctggcccagggcgggagtgccggctggggcgcgctgctcttcacgctctctgatggcgtgctggcctgggacaccttcgcccagcccctgccccatgcccacctggtgatcatgaccacctactatgctgcccagctcctcatcacactgtcagccctcaggagcccggtgcccaagactgactgactagggagcttgaagggccggtgttcaggccctctcctcctgcaaggacctgggcctcccagcccagcccagcctgagaaataccctcagcagcgaagcttcctgacgcctgtctgcaggcgccgctgccgccgtcgcttctggctgaagacgtttgaggacgatttgcggaattccaagtccactactgggttccagctgccttcccccggttctgactccagatccctggctcctcagccaggcccacatggagccctcccagccaccagcctgcctccatgttcactgtcggccccacagcctgcccgccccctgctgctgctctgaatccgttttccctgtgggtgtggaaccgtagatgttgctgttaccgtaggagaggcctcggggagggtcatcattgtgataaaccatcgcggttaatgacagcagaaggttctttgtcgctccccatggaccaggcctggtgcccagtgggaccctccatggccctctggtggggggattcggggggataaagtgaggattgtgcagaactgaaaaaaagg

SEQ ID NO: 300622 - DNA, 5804 bp, Homo sapiens
  misc_feature (47)..(47): n is a, c, g, or t
gagcgggcgcgagtcccgacgccgccccgccctctactcaccgggcnccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacgattctgctggtcagaccttacgttctgggatgcggggtggggagcctgtattatccctgcaccccagaggctgggggtgctcctgacccagtctgcccccacactgtcctgccagagggagccctgtggctgcagaggccccaggctgggccaggcactggctgtgagggctcctgccaggtctaccccacctgtgggcagggccttgggcagaggatagaagccaccgacaggctcaaatccctgctcctgcccctgcttacccccagtaaccaagcccagcattgaggctgggtactggcgcccagtaggtctgagtctttcaggtagaaggtagaagtgtaggctgcgtgtgcagcgagtggcaccggtgagcggcgctgggaaaccggagcgtgtggaccgggccatgaggacagcgtcctcactggggtggcagttggcttggaggtcacctgggggctcgctcagctaacaggagagggtgcttgttccccgcattcgtggtggtccctcctggtcacccattgaagcagtgtttgtggtggagcccctgagggcttggtggggttgagcagaatgaggaaaggtttcatggagcagggagggagacggctagggcagcaagtgaaggacagactcgccttcccatccctccaggggcactcctgccagccagcccctctcccgcttcccatgatggggtggctgttggaattctgcaccccatctcttctgattgttggggcccaggacaaggggacaggcatttgtgggcctaacctccccaggcagataggaggaggaagccatgtcccagcaggctagggcagagggacccccagtgccaacagtgctttatcagcgggcgccaggcagggccatccccagggtgaggacaacatctccctgggccctgttatcagtcacagagtccacaggacgctccttgggttaacgtgtaaccatgagccctcccctccaccccctgaagccactcgctcccagattaggtcgctctggggctatcaggccagcatggacgctggcaaagcggggcagaccctgaagactcactgctcagcccagcgcccagatgtctgcaggtggctgagccccttcatcctctcctgctgcgtgtacttctgcctctggattcccgaggaccagctgtcctggttcgctgccctggtcaagtgcctgcctgtcctctgcctggctgggttcctgtgggtcatgtccccaagcgggggctacacccagctcctccagggagcccttgtgtgctcggctgtgggggacgcttgcctcatctggccggcagccttcgtccctggcatggccgcctttgccaccgccacctcctctacgtctgggccttcggcttctctcccctgcagcccggctgctgctgctcatcatcctggcccctggccctacctcagccttgtgctccagcacctcgagccggatatggtcctgccggtggcagcctatgggctgatcctgatggccatgctgtggcgcggcctggcccagggcgggagtgccggctggggcgcgctgctcttcacgctctctgatggcgtgctggcctgggacaccttcgcccagcccctgccccatgcccacctggtgatcatgaccacctactatgctgcccagctcctcatcacactgtcagccctcaggagcccggtgcccaagactgactgactagggagcttgaagggccggtgttcaggccctctcctcctgcaaggacctgggcctcccagcccagcccagcctgagaaataccctcagcagcgaagcttcctgacgcctgtctgcaggcgccgctgccgccgtcgcttctggctgaagacgtttgaggacgatttgcggaattccaagtccactactgggttccagctgccttcccccggttctgactccagatccctggctcctcagccaggcccacatggagccctcccagccaccagcctgcctccatgttcactgtcggccccacagcctgcccgccccctgctgctgctctgaatccgttttccctgtgggtgtggaaccgtagatgttgctgttaccgtaggagaggcctcggggagggtcatcattgtgataaaccatcgcggttaatgacagcagaaggttctttgtcgctccccatggaccaggcctggtgcccagtgggaccctccatggccctctggtggggggattcggggggataaagtgaggattgtgcagaactgaaaaaaagg

SEQ ID NO: 300623 - DNA, 3568 bp, Homo sapiens
  misc_feature (47)..(47): n is a, c, g, or t
gagcgggcgcgagtcccgacgccgccccgccctctactcaccgggcnccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacgaaaaaaaaaaacaacgaagtgcatccgaccg

SEQ ID NO: 300624 - DNA, 3558 bp, Homo sapiens
  misc_feature (47)..(47): n is a, c, g, or t
gagcgggcgcgagtcccgacgccgccccgccctctactcaccgggcnccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacgaaaaaaaaaaaaccacacaac

SEQ ID NO: 300625 - DNA, 3489 bp, Homo sapiens
  misc_feature (47)..(47): n is a, c, g, or t
gagcgggcgcgagtcccgacgccgccccgccctctactcaccgggcnccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacga

SEQ ID NO: 300626 - DNA, 3460 bp, Homo sapiens
  misc_feature (47)..(47): n is a, c, g, or t
gagcgggcgcgagtcccgacgccgccccgccctctactcaccgggcnccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccacgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacga

SEQ ID NO: 300627 - DNA, 3355 bp, Homo sapiens
  misc_feature (47)..(47): n is a, c, g, or t
gagcgggcgcgagtcccgacgccgccccgccctctactcaccgggcnccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacaccctgttgccaagtgaccttgtccccagctccctcctcccaggctggtgtgagtgtgcgtgcgtttgtgccgagcttctatttcatattgcaaatataaataaaggaaggcagtttacga

SEQ ID NO: 300628 - DNA, 2259 bp, Homo sapiens
ggttgctgtcataccagtgctggacctgttcttccacatatgtcttggacttgggaaaatcgctgcgcgagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacga

SEQ ID NO: 300629 - DNA, 3441 bp, Homo sapiens
  misc_feature (47)..(47): n is a, c, g, or t
gagcgggcgcgagtcccgacgccgccccgccctctactcaccgggcnccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccgagtggaggcagcacagacagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacga

SEQ ID NO: 300630 - DNA, 3105 bp, Homo sapiens
  misc_feature (47)..(47): n is a, c, g, or t
gagcgggcgcgagtcccgacgccgccccgccctctactcaccgggcnccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacga

SEQ ID NO: 300631 - DNA, 1671 bp, Homo sapiens
ctcaccatgccttgccttctctcctagcgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacga

SEQ ID NO: 300632 - DNA, 2461 bp, Homo sapiens
  misc_feature (47)..(47): n is a, c, g, or t
gagcgggcgcgagtcccgacgccgccccgccctctactcaccgggcnccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccggtgagtccccctccagtttcccttctccaagcttccaccacacggcagggccaaggggtccccccaacacatttggactgaggctgaagtgaatgaagaaaataaggaacctgcattggtgtgtgtattagttgggggcactttcacttttgagtgatagaaatctaattcaaggccaagcatggtgggctcatgtaatccctgagtgcctgtaatcccagtactttgggaggccagggcagatggattgcttgagctcaggagtttgagaccagccctgggcaacatagggagatcctgtctctacaaaaaatacaaaagttagatggg

SEQ ID NO: 300633 - DNA, 2209 bp, Homo sapiens
  misc_feature (47)..(47): n is a, c, g, or t
gagcgggcgcgagtcccgacgccgccccgccctctactcaccgggcnccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaacctacttgagatatgctacaaggaccgcatccagcagtttgatgatgatgaggaagaggaggacgaggaagaggcccagggctcaggggagtctgatggagaagatggcgcctggcagggcagccagctggccaggggggcccgtctgggccagccacctggtgtccgagtggaggcaccacacaccgtgaggaccaagaagaggggggacgacttcaagcccaaaggtagtaaataggggaaggc

SEQ ID NO: 300634 - DNA, 1790 bp, Homo sapiens
tgggaaggcctgtcactgtggtgaccgtgtgaggtgacggctgggaggtggcttgagagctggtgagtgggtctgtctgctctggttgccatggctgaggctcagcccacttccccagggcctgccctccacggatgactggcgacggacggtctccttacggccgcattctgtccctgcccgcctgtgttcttgccgttggctcagaactccctctcccagcctctcctggtgtcgtcacaccccaggctccctggacccttctgtgacctgcctgtcatcccagcccgctctccttgggctgaccctgggctgcagggaacaggatgggtgtcggccggtctgtcccacacagctagctgacgaggtggtttctggggcaggagtggaggcagcacagacagtgaggacgaagaagaggaggacgaggaggaggaggaagacgaggagggcattggctgtgcagcccgtggaggggccacccctctgtcctaccccagccctggccctcagcctccaggccccagctggacagccacctttgacccagtgcctacagatgccccgaccagcccccgagtctccggggaggaagagctgcacactgggcctccagccccacaggggcccctcagtgtgccccagggcctccccactcagagcctggccagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacga

SEQ ID NO: 300635 - DNA, 2031 bp, Homo sapiens
  misc_feature (47)..(47): n is a, c, g, or t
gagcgggcgcgagtcccgacgccgccccgccctctactcaccgggcnccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgaggaggctgtgctgcagcaggccttcatggacttccagatgcagcgcatgacctctgccttcattgaccacttcggcttcaatgatgaggagtttggggagcaggaggagagtgtgaacgcaccttttgacaagacagccaacatcaccttctccctcaatgctgacgatgagaaccccaacgccaaccgacctggattcgcgaccgacctggattcgcgaccgacctggattcgcgaccgacctggattcgcga

SEQ ID NO: 300636 - DNA, 2172 bp, Homo sapiens
  misc_feature (47)..(47): n is a, c, g, or t
gagcgggcgcgagtcccgacgccgccccgccctctactcaccgggcnccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggacctcttcttccattatgtcttcaacaacttcttgcatgcccaagtagagggatgcgtgagcaccatgctgagcttggggccacctcctgacagcagccctgagacgcccatccaaaaccctgttgtgaaacatctgctgcagcagtgccgcctggtggagcggatcctgacgtcctgggaggagaacgaccgtgtacagtgtgcgggaggccctcggaaaggctacatgggtcacctgacaagagtggccggtgccctggtgcagaacacggagaaggggcccaatgcagagcagctgcggcagctgctgaaggagctgcccagcgagcagcaggagcagtgggaagccttcgtatcggggcccctggcggagaccaacaagaagaacatggtggacctggtgaacacccaccacctacactcctccagtgacgatgaggacgaccggctcaaggagttcaacttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacga

SEQ ID NO: 300637 - DNA, 1161 bp, Homo sapiens
ttcggctagtacgaggctgggtgttacactcagagctggcagccctcctgcccgtgacgccctgcagctcaggtctcaggaccccacacccccctcagcacctcaggaagccacagaaggcagcaaagtcacggagccctcagccccttgccaggccttggttagcatcggggaccttcaggccaccttccacgggatccgttctgcccccagctcctcggacagtgcaaccagagacccctctacctctgtcccagcctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacga

SEQ ID NO: 300638 - DNA, 1154 bp, Homo sapiens
gaggccggccgcagagcccggagattgagcggctttggggaaggggtggttaaggaagtaggcctcggcttccgtcggtcgctgctcggctctgcggcccgtttggaccgcggaggaggtctgccttcccctcccgtggggcgctcggtctgtgactgtggaaacctggtggcaacttcccccgtcttccctggctgagtgctgcctgcgtgggcctcgcgaccctggctctgccaaccctgcctcgtgccctccggggcccaccagcccccccagaccacagaaggggagaagagcccagagcccttggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacga

SEQ ID NO: 300639 - DNA, 905 bp, Homo sapiens
taggctagtcagcctgtgtgatcggccgaggcacagaacgggagaatagccagagccctggggcttccccaaagccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacga

SEQ ID NO: 300640 - DNA, 883 bp, Homo sapiens
  misc_feature (9)..(9): n is a, c, g, or t
acccacgcngtcgagagtgcccaggccctctggctttggggaagccccaaggccagagtgcccaggccctcacgcctcctccgatacccaatggctctgccccggaagggcctgcatccccaggctcccaatagctgcctggtgcggcagcggcggccaaatcttccgtcctcccgtggatctcccggggtgggggcagggcgggtcccacgatggcccccattgccctcatcaccctgacacccccacattctctcctctggacccccaggaggctggtgccagggagacaggcccaacccacccccatttgcactgagaagagaagttttggagcgttgcctcctagaataaagatacagagagtcaaatagagagaatggagagagagaaacatatattatatattatatagagagagggaggagagcgagagagagtgaggacaccgaactgggctggcggctccaaagcacagccttccctgttccgtcccagcgggagctggtgttaggggtcccaaggttgccacccacgtgcccagctgtcccacgctgcagcgcagacggccacgcccacacccggccttttagctcaggtccaccatgggggacggcccagcgtgggtgggggtgccagagggtcccgagtgggggccgtgcctttgcccagaccctgcactttcaaccaggccagtccggctctggggagcaggggcctccccggcaacagccccaggggccttgagggtctgaggtcccagccctgttgccaagtgaccttgtccccagctccctcctcccaggctggtgtgagtgtgcgtgcgtttgtgccgagcttctatttcatattgcaaatataaataaaggaaggcagtttacga

SEQ ID NO: 300641 - DNA, 1551 bp, Homo sapiens
  misc_feature (47)..(47): n is a, c, g, or t
gagcgggcgcgagtcccgacgccgccccgccctctactcaccgggcnccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagattctgacctcagatgtgccccagatcaatgatgccctgggtgctgatgagtcccttctgaaccggctctacggcttcctgcagagcaccggcagcctcaacccactgctggccagcttcttcagcaaggtcatgggcatcctcatcaaccgcaagacagaccagctcgtgtcctttcttcggaagaaggatgacttcgtggacctgctgctgcagcacattggcacctcggccatcatggacctcctgctgcgcctgctcacctgtgtggagcggcctcagctgaggcaggatgttgtcaattggctcaacgaggagaagatcgtccagcggctgattgagcagatccacccgtcgaaggatgagaatcaacattccaacgcatcccagtccctgtgtgacatcatccgcctgagccgggagcagatgatccaagtccaggacagcccagagcctgaccaactgctggccaccctggagaagcaggagacgattgagcagctcttaagcaacatgttcgagggggagcagagccagtctgtcatcgtcagtgggatccaggtgctgctgaccctgctggagcccaggaggccgaggtccgagtccgtgaccgtgaacagcttcttcagcagtgtggatgggcagctggagctcctggcccagggggccctggaaagcactgtgtccagtgtgggcgccttgcacgccctacgcccgcggctcagctgcttccaccagctcctgctggagcctcccaagctggagccgctacagatgacatggggcatgctggctccgcctctgggcaacacgcggctgcacgtggtcaagctcctggccagtgccctgagcgccaatgatgcagccctgacgcacgagctcctggcactggacgtgcccaacaccatgctggactcttctcattatgtcttccacacttcttggctgccagttggggtgcgtgagccctggtggctgggggccctctgaggaggctggaggcatcaaacctgtgtgaaccttgtgcgggtgcgccgggagggcctagcctgggggaccggcgggcggggccgaggactgggccgaagggccctgtaagacaggccccagggcttgtccccagggattcacggaaaggggcccctggggcgtcctcggg

SEQ ID NO: 300642 - DNA, 756 bp, Homo sapiens
  misc_feature (47)..(47): n is a, c, g, or t
gagcgggcgcgagtcccgacgccgccccgccctctactcaccgggcnccgcagcaggggccggagccgccggcggcggggcgggggggggcgccccgatgagccccgagtgcgaggagccgccgccccccctcgcagggcgccatgttttggaagtttgacctgcacacaagctcgcacctggacacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtgagttccccagctcctggccagcccgtccctatcagcatcacacataccttcactacgcaagcctcacagctaccctgaaatgcgtcagtgtcagtaaactccagtttggggatgaggaagacgaggctgggagcagccaggctcctgcacaaggcctcacagctcaccgggtgcagaccaagcctgtgctctggagggcagtggcacagtcacgggtcacggcagccacaaattcacgggcccaggtgatcctcccgcctcagttgcccgagtagctgggaccacaggcatgtgacgacatgcccggctggtttttctctttattcgccgccttttattttatttactttttattaaactttttttgtatgtttgtgaaacac

SEQ ID NO: 300643 - DNA, 903 bp, Homo sapiens
gagctgattcctgcaaacaccattagagcacctggtatgtagtaaacctctgatcactgctcttgtcagaggcacgggacatgtttccatgtgcacccagcctgttctcttgtggattctgtgagggcagaatagatcctcttcatcacccaaggcaggctgggctctttctcctggcccctcattggttcattcggcagctgtttatttagaacctgccgtgtgctagggcagatctgggatacagctgtggacaagggaggatgaggtgtctgttttcatagagcttttggggagaccagaattaaacaatagtcatacaagaaatcacaacacagatcataatgagggtaaaggggacagtttgccaggagcacacgaaggtgggggctggggtgcacagggaggctgagggctgcaggatgccgtggagccaactgagtgagggtctggagtaagaagatttcaggctaagggaaattggaatgctcgttgagttcaagaacagcgctaaggccagaagctgcccttcctcctcatcctggcccctccccagcccccgccaatactgtgaacccccttcccactcagcctggtttcctggtgagggtcctgcagtcatgggccctgggggacccccagggcaaggcccatgggagggaagggaccaagggcatccttgggccaactgtccacctctcttgtccactattctctcctttccacttctgtcttcaaaaggctccttcctaggatggatcgggtgctaggacaactgcagtccaatccaccagctctccctgcccctgtgtcttatttcagacatgagaataactgtacagtgtaaacttataaagcgtttttaatggttgtagattggaaataaagtatgtcatatgaaca

SEQ ID NO: 300644 - DNA, 4756 bp, Homo sapiens
ggctctttgtcgctctcccctcctatctacgaatgtcccctgctctctgagcctcaccatgaccccaccgaaggtcccactacttcttccatgataatagtaataacaatggttatcatcatcccctgcacatcccgcctaaagcactttactatatagaaaacgtttcccctggccgggcatggtggctcacgcctgaaatcccagctctttgggaggctgaggcgagcggatcagttgaggtcaggagttcaacgccagcctggccaacgtggtgaatccctgtctgtactaaaagtacaaaaaattagctgagcatggtggtgcgtgcctgtaatcccagctactcgggaggctgaggtgggagaatcgcttgagcccaggaggcggaggttgcaggagcagagattgcgccactgcactccagcctggatgacagagtgagacccaatctcaaaaaagaaatcgtttcccaccccacatctccttcagacctctcagggacaactctgggaggcagccttggcaggacatgggttagtgcgcccattttgctgtgaggaaactgaggtacaggtctcatcccagagcatgagaagtcactgagtttagatgagaacttgggtccaactctgtcctgtttgctgtgcaaatccgctgccctgctgggggcttttggtgggtccagaatacccagaatatgctgctggccaacccaggcataaaacaagtccattctagatcactgagccttgtgtattccagagggtgatctgaggtccccattcagcagaattctctgagggcatgttcagaatgtagattcctgggccccaccttgaatttgcatgtttaacaaactctcctggggttgaggggtgggtgcagtggtcacacctgtaatcccaaagtactgggattataggcgtgagccacggcatccagcctcatctttcttttaaccaataaacatgatgctgtatcttaaaaagagcactgagcagggacttaagggatcgagtcctcaaccaaactgatttaattactcaggattttcaaaaagcatcagaggctatttacaatcttaatcataggggttcagtaaaataaaaataagaagtaaaaaagcaagagaaattattctgtaaatctaactggtgtaattcccataatcatgcaattaagttttactcttgagtttcctgacagccattggtaaaaagagaaacacatcaggatttataatttttatcatccaattatgggaagcaagcatgttggccccaggagacgaactcttctactaatttatagcatgtatcctttcatcaagggccactgagccagttggtgagtcaacgggtgaacctaagatgcaaggatgttttccaggtgactatttaaaaaaataaataatccaccaacgtgattgaccttggcgagatcatgtttctagtctatacctcagtttccccatctgtaaagtgaggataatgtcccaccccatgtaactgtggtgaggaccaactgcaacactgtgcctgcgagtctccttggaaaagtgtaaggttctacacaaatggaaagtgatctgatcacactcagtgtccccagcccagcctttcagtgccctggccctggggtgggggacaatactctcctcacccccttcactagtcttcatgaatagcaaggaggccataacataatttggtctaaaccccttcctttttaaaagaatgatggcaaaatgtgcataacattaaatttaccattttaaagatttctaagtgtctcgaagtacatttgcaatgtgtaactgccacctccagaactttttcatcatcctaaactgaaactctgtacccactaaacagtaactccccactccccctgtccccagtccctggtaacctctattctacttttttttttctctgtggattggcctattctaggtatctcttttaagtagaatcatatagtatttgtccttttgtgtccagccccctcattttttgagatgaggaatcaggcccagagaaggcagtggctcacccaaggtcacatcgcaaaccagaggcagagccaagaccagaacccaggtttcctgactcctaacaggtcttgcatccccagtagtgaatgagacactgctttgactttctgtaatcttggtttagccccttcctttctctgggctcagtctgcttcccaccactcacccattctttctttatcatctccctccaaagcctcttgtcctcctgcctcctcttctccttggctggttcctgccagcaaatggagtggccctggtccatgccaggttttcctcttctgggtccggagctcactatagtattcagccctcagtcctcccaggatgttcttcccagcactgctgcctcgtgcggattttcccgtaacctcagtaactggcttcttgtccccctgcttcctaccagggaagccttcctgtccgcgtctgtggtttcccaactctgatatttgctctcaaatgtggtggtgtcctggttctgtgtttatttattttgtgttttctcacacacacaaaaaaaagcctcttcctccaatgcatcaggaggcaccagccctgccagcccttctcactgggctcaccctgccccagcaaccccccggtgccacccttaagccacactgtcttctctgtaagcagcctgccagcagcagccccagcactttgcaatgggcgtgtgtgtggtggtgggtggggggggcttggatccctcctttttcctcccctgccctgcccaggcccagatggccttgactgtaaagcaggtgctgcctgacaggttcttctctccctgtctctggtcattgatccatctctttgtccattcagtatccaaccatcctctccattctcctctggacctcaccactctcagagctgcttgtcctggcagaatctacaattcaccccaactctatgccttacccctcccaacccaacagcatttgcagtttgcaaaatatacagacccaagtcctgaggggactgaggacatgatgctgggcccaagtctcctgctcagggcttctctccaatgccagccctgccactccttcctcaccctccttggagcctcctcctgctgcttgtctatcccaacggccctgctcccctcccttcctgcccttcaccagctttctggacaccatgccctgaggaagggacctttggttttctctaaacatctttgaagggctgaggcagtcagggctggctgccttgtcactctttatttggaagccactcaaaccattcccaagaagagggacctcagctggcaatctggaaacctggcccaggtctgggcagatgtcttcacttctcctaccttcccagtcttgtgatcctgtgatgagcaccaggatggccctgtggtccctagagcacccctcatgctgtagggtcctgcagccccatcctttctctactgggccctggtatcctggctcctctctcagctctgccactgatctctgtgccttagtttacttctctgcacgggggactcaccccaagaccatttccagcagcttcccaggtgatgtggtgccccaaggctgggctttgccagctgtggcccagctccttagtgctgcccaggagacaccaggctgctcagaatgaggtgactgcgggcaccattctcagccagtggttcttgtattgcattccagcagcaggaatatcacctgggaacttgatagaagtgcagattagcagccccacccaagacccactgaattagagcttgtggagtggggccctacaagctggggttttaaggagccctccaaatgattctgacgcataagaatatgccaactgctgatctgggctagccattagtagagcctggggagggactgggactggctaggccaagaacaggtggaaaacaccagccttatctggactcctgagattgggaaccaccaccaacaaaaaccaaccctatagtcgctcctcttggaagaggaagagaagttgaagggcctggagaaagcacacattgtttgtttccctgctcctgctcacctctctcacttgtcttggttttacaaaaggctgtgtggatggtgccagccagggagggggtgggagtcctggggaggcaggaggcagaagaccctgactgtttctcccttgggaacctcaccataggccagatagcgcctcttcaaactgaaagaaatcttaactccacaaagaaagcatcctaaatccccagttcctcctcctcccaaccccagggataccttgtagacagtgccaaaaaacagctccaacccccagcagctgggaagagagccagaagctgcccttcctcctcatcctggcccctccccagcccccgccaatactgtgaacccccttcccactcagcctggtttcctggtgagggtcctgcagtcatgggccctgggggacccccagggcaaggcccatgggagggaagggaccaagggcatccttgggccaactgtccacctctcttgtccactattctctcctttccacttctgtcttcaaaaggctccttcctaggatggatcgggtgctaggacaactgcagtccaatccaccagctctccctgcccctgtgtcttatttcagacatgagaataactgtacagtgtaaacttataaagcgtttttaatggttgtagattggaaataaagtatgtcatatgaaca

SEQ ID NO: 300645 - DNA, 3994 bp, Homo sapiens
tcaacctcccgagtaactgggattacaggtgtgtgccaccacacccgactaatttttttatttttagtagagacggggtttcaccatgttggccaggctggtcttgaactcctgacctcaggtgatccacccacctcggcctcccaaagtactgggattataggcgtgagccacggcatccagcctcatctttcttttaaccaataaacatgatgctgtatcttaaaaagagcactgagcagggacttaagggatcgagtcctcaaccaaactgatttaattactcaggattttcaaaaagcatcagaggctatttacaatcttaatcataggggttcagtaaaataaaaataagaagtaaaaaagcaagagaaattattctgtaaatctaactggtgtaattcccataatcatgcaattaagttttactcttgagtttcctgacagccattggtaaaaagagaaacacatcaggatttataatttttatcatccaattatgggaagcaagcatgttggccccaggagacgaactcttctactaatttatagcatgtatcctttcatcaagggccactgagccagttggtgagtcaacgggtgaacctaagatgcaaggatgttttccaggtgactatttaaaaaaataaataatccaccaacgtgattgaccttggcgagatcatgtttctagtctatacctcagtttccccatctgtaaagtgaggataatgtcccaccccatgtaactgtggtgaggaccaactgcaacactgtgcctgcgagtctccttggaaaagtgtaaggttctacacaaatggaaagtgatctgatcacactcagtgtccccagcccagcctttcagtgccctggccctggggtgggggacaatactctcctcacccccttcactagtcttcatgaatagcaaggaggccataacataatttggtctaaaccccttcctttttaaaagaatgatggcaaaatgtgcataacattaaatttaccattttaaagatttctaagtgtctcgaagtacatttgcaatgtgtaactgccacctccagaactttttcatcatcctaaactgaaactctgtacccactaaacagtaactccccactccccctgtccccagtccctggtaacctctattctacttttttttttctctgtggattggcctattctaggtatctcttttaagtagaatcatatagtatttgtccttttgtgtccagccccctcattttttgagatgaggaatcaggcccagagaaggcagtggctcacccaaggtcacatcgcaaaccagaggcagagccaagaccagaacccaggtttcctgactcctaacaggtcttgcatccccagtagtgaatgagacactgctttgactttctgtaatcttggtttagccccttcctttctctgggctcagtctgcttcccaccactcacccattctttctttatcatctccctccaaagcctcttgtcctcctgcctcctcttctccttggctggttcctgccagcaaatggagtggccctggtccatgccaggttttcctcttctgggtccggagctcactatagtattcagccctcagtcctcccaggatgttcttcccagcactgctgcctcgtgcggattttcccgtaacctcagtaactggcttcttgtccccctgcttcctaccagggaagccttcctgtccgcgtctgtggtttcccaactctgatatttgctctcaaatgtggtggtgtcctggttctgtgtttatttattttgtgttttctcacacacacaaaaaaaagcctcttcctccaatgcatcaggaggcaccagccctgccagcccttctcactgggctcaccctgccccagcaaccccccggtgccacccttaagccacactgtcttctctgtaagcagcctgccagcagcagccccagcactttgcaatgggcgtgtgtgtggtggtgggtggggggggcttggatccctcctttttcctcccctgccctgcccaggcccagatggccttgactgtaaagcaggtgctgcctgacaggttcttctctccctgtctctggtcattgatccatctctttgtccattcagtatccaaccatcctctccattctcctctggacctcaccactctcagagctgcttgtcctggcagaatctacaattcaccccaactctatgccttacccctcccaacccaacagcatttgcagtttgcaaaatatacagacccaagtcctgaggggactgaggacatgatgctgggcccaagtctcctgctcagggcttctctccaatgccagccctgccactccttcctcaccctccttggagcctcctcctgctgcttgtctatcccaacggccctgctcccctcccttcctgcccttcaccagctttctggacaccatgccctgaggaagggacctttggttttctctaaacatctttgaagggctgaggcagtcagggctggctgccttgtcactctttatttggaagccactcaaaccattcccaagaagagggacctcagctggcaatctggaaacctggcccaggtctgggcagatgtcttcacttctcctaccttcccagtcttgtgatcctgtgatgagcaccaggatggccctgtggtccctagagcacccctcatgctgtagggtcctgcagccccatcctttctctactgggccctggtatcctggctcctctctcagctctgccactgatctctgtgccttagtttacttctctgcacgggggactcaccccaagaccatttccagcagcttcccaggtgatgtggtgccccaaggctgggctttgccagctgtggcccagctccttagtgctgcccaggagacaccaggctgctcagaatgaggtgactgcgggcaccattctcagccagtggttcttgtattgcattccagcagcaggaatatcacctgggaacttgatagaagtgcagattagcagccccacccaagacccactgaattagagcttgtggagtggggccctacaagctggggttttaaggagccctccaaatgattctgacgcataagaatatgccaactgctgatctgggctagccattagtagagcctggggagggactgggactggctaggccaagaacaggtggaaaacaccagccttatctggactcctgagattgggaaccaccaccaacaaaaaccaaccctatagtcgctcctcttggaagaggaagagaagttgaagggcctggagaaagcacacattgtttgtttccctgctcctgctcacctctctcacttgtcttggttttacaaaaggctgtgtggatggtgccagccagggagggggtgggagtcctggggaggcaggaggcagaagaccctgactgtttctcccttgggaacctcaccataggccagatagcgcctcttcaaactgaaagaaatcttaactccacaaagaaagcatcctaaatccccagttcctcctcctcccaaccccagggataccttgtagacagtgccaaaaaacagctccaacccccagcagctgggaagagagccagaagctgcccttcctcctcatcctggcccctccccagcccccgccaatactgtgaacccccttcccactcagcctggtttcctggtgagggtcctgcagtcatgggccctgggggacccccagggcaaggcccatgggagggaagggaccaagggcatccttgggccaactgtccacctctcttgtccactattctctcctttccacttctgtcttcaaaaggctccttcctaggatggatcgggtgctaggacaactgcagtccaatccaccagctctccctgcccctgtgtcttatttcagacatgagaataactgtacagtgtaaacttataaagcgtttttaatggttgtagattggaaataaagtatgtcatatgaaca

SEQ ID NO: 300646 - DNA, 4949 bp, Homo sapiens
ggctctttgtcgctctcccctcctatctacgaatgtcccctgctctctgagcctcaccatgaccccaccgaaggtcccactacttcttccatgataatagtaataacaatggttatcatcatcccctgcacatcccgcctaaagcactttactatatagaaaacgtttcccctggccgggcatggtggctcacgcctgaaatcccagctctttgggaggctgaggcgagcggatcagttgaggtcaggagttcaacgccagcctggccaacgtggtgaatccctgtctgtactaaaagtacaaaaaattagctgagcatggtggtgcgtgcctgtaatcccagctactcgggaggctgaggtgggagaatcgcttgagcccaggaggcggaggttgcaggagcagagattgcgccactgcactccagcctggatgacagagtgagacccaatctcaaaaaagaaatcgtttcccaccccacatctccttcagacctctcagggacaactctgggaggcagccttggcaggacatgggttagtgcgcccattttgctgtgaggaaactgaggtacaggtctcatcccagagcatgagaagtcactgagtttagatgagaacttgggtccaactctgtcctgtttgctgtgcaaatccgctgccctgctgggggcttttggtgggtccagaatacccagaatatgctgctggccaacccaggcataaaacaagtccattctagatcactgagccttgtgtattccagagggtgatctgaggtccccattcagcagaattctctgagggcatgttcagaatgtagattcctgggccccaccttgaatttgcatgtttaacaaactctcctggggttgaggggtgggtgcagtggtcacacctgtaatcccaaagtactgggattataggcgtgagccacggcatccagcctcatctttcttttaaccaataaacatgatgctgtatcttaaaaagagcactgagcagggacttaagggatcgagtcctcaaccaaactgatttaattactcaggattttcaaaaagcatcagaggctatttacaatcttaatcataggggttcagtaaaataaaaataagaagtaaaaaagcaagagaaattattctgtaaatctaactggtgtaattcccataatcatgcaattaagttttactcttgagtttcctgacagccattggtaaaaagagaaacacatcaggatttataatttttatcatccaattatgggaagcaagcatgttggccccaggagacgaactcttctactaatttatagcatgtatcctttcatcaagggccactgagccagttggtgagtcaacgggtgaacctaagatgcaaggatgttttccaggtgactatttaaaaaaataaataatccaccaacgtgattgaccttggcgagatcatgtttctagtctatacctcagtttccccatctgtaaagtgaggataatgtcccaccccatgtaactgtggtgaggaccaactgcaacactgtgcctgcgagtctccttggaaaagtgtaaggttctacacaaatggaaagtgatctgatcacactcagtgtccccagcccagcctttcagtgccctggccctggggtgggggacaatactctcctcacccccttcactagtcttcatgaatagcaaggaggccataacataatttggtctaaaccccttcctttttaaaagaatgatggcaaaatgtgcataacattaaatttaccattttaaagatttctaagtgtctcgaagtacatttgcaatgtgtaactgccacctccagaactttttcatcatcctaaactgaaactctgtacccactaaacagtaactccccactccccctgtccccagtccctggtaacctctattctacttttttttttctctgtggattggcctattctaggtatctcttttaagtagaatcatatagtatttgtccttttgtgtccagccccctcattttttgagatgaggaatcaggcccagagaaggcagtggctcacccaaggtcacatcgcaaaccagaggcagagccaagaccagaacccaggtttcctgactcctaacaggtcttgcatccccagtagtgaatgagacactgctttgactttctgtaatcttggtttagccccttcctttctctgggctcagtctgcttcccaccactcacccattctttctttatcatctccctccaaagcctcttgtcctcctgcctcctcttctccttggctggttcctgccagcaaatggagtggccctggtccatgccaggttttcctcttctgggtccggagctcactatagtattcagccctcagtcctcccaggatgttcttcccagcactgctgcctcgtgcggattttcccgtaacctcagtaactggcttcttgtccccctgcttcctaccagggaagccttcctgtccgcgtctgtggtttcccaactctgatatttgctctcaaatgtggtggtgtcctggttctgtgtttatttattttgtgttttctcacacacacaaaaaaaagcctcttcctccaatgcatcaggaggcaccagccctgccagcccttctcactgggctcaccctgccccagcaaccccccggtgccacccttaagccacactgtcttctctgtaagcagcctgccagcagcagccccagcactttgcaatgggcgtgtgtgtggtggtgggtggggggggcttggatccctcctttttcctcccctgccctgcccaggcccagatggccttgactgtaaagcaggtgctgcctgacaggttcttctctccctgtctctggtcattgatccatctctttgtccattcagtatccaaccatcctctccattctcctctggacctcaccactctcagagctgcttgtcctggcagaatctacaattcaccccaactctatgccttacccctcccaacccaacagcatttgcagtttgcaaaatatacagacccaagtcctgaggggactgaggacatgatgctgggcccaagtctcctgctcagggcttctctccaatgccagccctgccactccttcctcaccctccttggagcctcctcctgctgcttgtctatcccaacggccctgctcccctcccttcctgcccttcaccagctttctggacaccatgccctgaggaagggacctttggttttctctaaacatctttgaagggctgaggcagtcagggctggctgccttgtcactctttatttggaagccactcaaaccattcccaagaagagggacctcagctggcaatctggaaacctggcccaggtctgggcagatgtcttcacttctcctaccttcccagtcttgtgatcctgtgatgagcaccaggatggccctgtggtccctagagcacccctcatgctgtagggtcctgcagccccatcctttctctactgggccctggtatcctggctcctctctcagctctgccactgatctctgtgccttagtttacttctctgcacgggggactcaccccaagaccatttccagcagcttcccaggtgatgtggtgccccaaggctgggctttgccagctgtggcccagctccttagtgctgcccaggagacaccaggctgctcagaatgaggtgactgcgggcaccattctcagccagtggttcttgtattgcattccagcagcaggaatatcacctgggaacttgatagaagtgcagattagcagccccacccaagacccactgaattagagcttgtggagtggggccctacaagctggggttttaaggagccctccaaatgattctgacgcataagaatatgccaactgctgatctgggctagccattagtagagcctggggagggactgggactggctaggccaagaacaggtggaaaacaccagccttatctggactcctgagattgggaaccaccaccaacaaaaaccaaccctatagtcgctcctcttggaagaggaagagaagttgaagggcctggagaaagcacacattgtttgtttccctgctcctgctcacctctctcacttgtcttggttttacaaaaggctgtgtggatggtgccagccagggagggggtgggagtcctggggaggcaggaggcagaagaccctgactgtttctcccttgggaacctcaccataggccagatagcgcctcttcaaactgaaagaaatcttaactccacaaagaaagcatcctaaatccccagttcctcctcctcccaaccccagggataccttgtagacagtgccaaaaaacagctccaacccccagcagctgggaagagagccagaagctgcccttcctcctcatcctggcccctccccagcccccgccaatactgtgaacccccttcccactcagcctggtttcctggtgagggtcctgcagtcatgggccctgggggacccccagggcaaggcccatgggagggaagggaccaagggcatccttgggccaactgtccacctctcttgtccactattctctcctttccacttctgtcttcaaaaggctccttcctaggatggatcgggtgctaggacaactgcagtccaatccaccagctctccctgcccctgtgtcttatttcagacatgagaataactgtacagtgtaaacttataaagcgtttttaatggttgtagattggaaataaagtatgtcatatgaacaaaaaaaaaaaaaaaaaaaaaaaaaaaaaaaaaaaaaaaaaaaaaaaaaaaaaaaaaaaaaaaaaaaaaaaaaagaaggaggagaaaaaaaaagtaatcaaaagggagagaagtggaaacgctttgggaggggctcatgggctgtataaaggagggggttttatcttgggtgggtacgggcggggtaatccttg

SEQ ID NO: 300647 - DNA, 4431 bp, Homo sapiens
ggctctttgtcgctctcccctcctatctacgaatgtcccctgctctctgagcctcaccatgaccccaccgaaggtcccactacttcttccatgataatagtaataacaatggttatcatcatcccctgcacatcccgcctaaagcactttactatatagaaaacgtttcccctggccgggcatggtggctcacgcctgaaatcccagctctttgggaggctgaggcgagcggatcagttgaggtcaggagttcaacgccagcctggccaacgtggtgaatccctgtctgtactaaaagtacaaaaaattagctgagcatggtggtgcgtgcctgtaatcccagctactcgggaggctgaggtgggagaatcgcttgagcccaggaggcggaggttgcaggagcagagattgcgccactgcactccagcctggatgacagagtgagacccaatctcaaaaaagaaatcgtttcccaccccacatctccttcagacctctcagggacaactctgggaggcagccttggcaggacatgggttagtgcgcccattttgctgtgaggaaactgaggtacaggtctcatcccagagcatgagaagtcactgagtttagatgagaacttgggtccaactctgtcctgtttgctgtgcaaatccgctgccctgctgggggcttttggtgggtccagaatacccagaatatgctgctggccaacccaggcataaaacaagtccattctagatcactgagccttgtgtattccagagggtgatctgaggtccccattcagcagaattctctgagggcatgttcagaatgtagattcctgggccccaccttgaatttgcatgtttaacaaactctcctggggttgaggggtgggtgcagtggtcacacctgtaatcccaaagtactgggattataggcgtgagccacggcatccagcctcatctttcttttaaccaataaacatgatgctgtatcttaaaaagagcactgagcagggacttaagggatcgagtcctcaaccaaactgatttaattactcaggattttcaaaaagcatcagaggctatttacaatcttaatcataggggttcagtaaaataaaaataagaagtaaaaaagcaagagaaattattctgtaaatctaactggtgtaattcccataatcatgcaattaagttttactcttgagtttcctgacagccattggtaaaaagagaaacacatcaggatttataatttttatcatccaattatgggaagcaagcatgttggccccaggagacgaactcttctactaatttatagcatgtatcctttcatcaagggccactgagccagttggtgagtcaacgggtgaacctaagatgcaaggatgttttccaggtgactatttaaaaaaataaataatccaccaacgtgattgaccttggcgagatcatgtttctagtctatacctcagtttccccatctgtaaagtgaggataatgtcccaccccatgtaactgtggtgaggaccaactgcaacactgtgcctgcgagtctccttggaaaagtgtaaggttctacacaaatggaaagtgatctgatcacactcagtgtccccagcccagcctttcagtgccctggccctggggtgggggacaatactctcctcacccccttcactagtcttcatgaatagcaaggaggccataacataatttggtctaaaccccttcctttttaaaagaatgatggcaaaatgtgcataacattaaatttaccattttaaagatttctaagtgtctcgaagtacatttgcaatgtgtaactgccacctccagaactttttcatcatcctaaactgaaactctgtacccactaaacagtaactccccactccccctgtccccagtccctggtaacctctattctacttttttttttctctgtggattggcctattctaggtatctcttttaagtagaatcatatagtatttgtccttttgtgtccagccccctcattttttgagatgaggaatcaggcccagagaaggcagtggctcacccaaggtcacatcgcaaaccagaggcagagccaagaccagaacccaggtttcctgactcctaacaggtcttgcatccccagtagtgaatgagacactgctttgactttctgtaatcttggtttagccccttcctttctctgggctcagtctgcttcccaccactcacccattctttctttatcatctccctccaaagcctcttgtcctcctgcctcctcttctccttggctggttcctgccagcaaatggagtggccctggtccatgccaggttttcctcttctgggtccggagctcactatagtattcagccctcagtcctcccaggatgttcttcccagcactgctgcctcgtgcggattttcccgtaacctcagtaactggcttcttgtccccctgcttcctaccagggaagccttcctgtccgcgtctgtggtttcccaactctgatatttgctctcaaatgtggtggtgtcctggttctgtgtttatttattttgtgttttctcacacacacaaaaaaaagcctcttcctccaatgcatcaggaggcaccagccctgccagcccttctcactgggctcaccctgccccagcaaccccccggtgccacccttaagccacactgtcttctctgtaagcagcctgccagcagcagccccagcactttgcaatgggcgtgtgtgtggtggtgggtggggggggcttggatccctcctttttcctcccctgccctgcccaggcccagatggccttgactgtaaagcaggtgctgcctgacaggttcttctctccctgtctctggtcattgatccatctctttgtccattcagtatccaaccatcctctccattctcctctggacctcaccactctcagagctgcttgtcctggtgccttgtcactctttatttggaagccactcaaaccattcccaagaagagggacctcagctggcaatctggaaacctggcccaggtctgggcagatgtcttcacttctcctaccttcccagtcttgtgatcctgtgatgagcaccaggatggccctgtggtccctagagcacccctcatgctgtagggtcctgcagccccatcctttctctactgggccctggtatcctggctcctctctcagctctgccactgatctctgtgccttagtttacttctctgcacgggggactcaccccaagaccatttccagcagcttcccaggtgatgtggtgccccaaggctgggctttgccagctgtggcccagctccttagtgctgcccaggagacaccaggctgctcagaatgaggtgactgcgggcaccattctcagccagtggttcttgtattgcattccagcagcaggaatatcacctgggaacttgatagaagtgcagattagcagccccacccaagacccactgaattagagcttgtggagtggggccctacaagctggggttttaaggagccctccaaatgattctgacgcataagaatatgccaactgctgatctgggctagccattagtagagcctggggagggactgggactggctaggccaagaacaggtggaaaacaccagccttatctggactcctgagattgggaaccaccaccaacaaaaaccaaccctatagtcgctcctcttggaagaggaagagaagttgaagggcctggagaaagcacacattgtttgtttccctgctcctgctcacctctctcacttgtcttggttttacaaaaggctgtgtggatggtgccagccagggagggggtgggagtcctggggaggcaggaggcagaagaccctgactgtttctcccttgggaacctcaccataggccagatagcgcctcttcaaactgaaagaaatcttaactccacaaagaaagcatcctaaatccccagttcctcctcctcccaaccccagggataccttgtagacagtgccaaaaaacagctccaacccccagcagctgggaagagagccagaagctgcccttcctcctcatcctggcccctccccagcccccgccaatactgtgaacccccttcccactcagcctggtttcctggtgagggtcctgcagtcatgggccctgggggacccccagggcaaggcccatgggagggaagggaccaagggcatccttgggccaactgtccacctctcttgtccactattctctcctttccacttctgtcttcaaaaggctccttcctaggatggatcgggtgctaggacaactgcagtccaatccaccagctctccctgcccctgtgtcttatttcagacatgagaataactgtacagtgtaaacttataaagcgtttttaatggttgtagattggaaataaagtatgtcatatgaaca

SEQ ID NO: 300648 - DNA, 4184 bp, Homo sapiens
ggctctttgtcgctctcccctcctatctacgaatgtcccctgctctctgagcctcaccatgaccccaccgaaggtcccactacttcttccatgataatagtaataacaatggttatcatcatcccctgcacatcccgcctaaagcactttactatatagaaaacgtttcccctggccgggcatggtggctcacgcctgaaatcccagctctttgggaggctgaggcgagcggatcagttgaggtcaggagttcaacgccagcctggccaacgtggtgaatccctgtctgtactaaaagtacaaaaaattagctgagcatggtggtgcgtgcctgtaatcccagctactcgggaggctgaggtgggagaatcgcttgagcccaggaggcggaggttgcaggagcagagattgcgccactgcactccagcctggatgacagagtgagacccaatctcaaaaaagaaatcgtttcccaccccacatctccttcagacctctcagggacaactctgggaggcagccttggcaggacatgggttagtgcgcccattttgctgtgaggaaactgaggtacaggtctcatcccagagcatgagaagtcactgagtttagatgagaacttgggtccaactctgtcctgtttgctgtgcaaatccgctgccctgctgggggcttttggtgggtccagaatacccagaatatgctgctggccaacccaggcataaaacaagtccattctagatcactgagccttgtgtattccagagggtgatctgaggtccccattcagcagaattctctgagggcatgttcagaatgtagattcctgggccccaccttgaatttgcatgtttaacaaactctcctggggttgaggggtgggtgcagtggtcacacctgtaatcccaaagtactgggattataggcgtgagccacggcatccagcctcatctttcttttaaccaataaacatgatgctgtatcttaaaaagagcactgagcagggacttaagggatcgagtcctcaaccaaactgatttaattactcaggattttcaaaaagcatcagaggctatttacaatcttaatcataggggttcagtaaaataaaaataagaagtaaaaaagcaagagaaattattctgtaaatctaactggtgtaattcccataatcatgcaattaagttttactcttgagtttcctgacagccattggtaaaaagagaaacacatcaggatttataatttttatcatccaattatgggaagcaagcatgttggccccaggagacgaactcttctactaatttatagcatgtatcctttcatcaagggccactgagccagttggtgagtcaacgggtgaacctaagatgcaaggatgttttccaggtgactatttaaaaaaataaataatccaccaacgtgattgaccttggcgagatcatgtttctagtctatacctcagtttccccatctgtaaagtgaggataatgtcccaccccatgtaactgtggtgaggaccaactgcaacactgtgcctgcgagtctccttggaaaagtgtaaggttctacacaaatggaaagtgatctgatcacactcagtgtccccagcccagcctttcagtgccctggccctggggtgggggacaatactctcctcacccccttcactagtcttcatgaatagcaaggaggccataacataatttggtctaaaccccttcctttttaaaagaatgatggcaaaatgtgcataacattaaatttaccattttaaagatttctaagtgtctcgaagtacatttgcaatgtgtaactgccacctccagaactttttcatcatcctaaactgaaactctgtacccactaaacagtaactccccactccccctgtccccagtccctggtaacctctattctacttttttttttctctgtggattggcctattctaggtatctcttttaagtagaatcatatagtatttgtccttttgtgtccagccccctcattttttgagatgaggaatcaggcccagagaaggcagtggctcacccaaggtcacatcgcaaaccagaggcagagccaagaccagaacccaggtttcctgactcctaacaggtcttgcatccccagtagtgaatgagacactgctttgactttctgtaatcttggtttagccccttcctttctctgggctcagtctgcttcccaccactcacccattctttctttatcatctccctccaaagcctcttgtcctcctgcctcctcttctccttggctggttcctgccagcaaatggagtggccctggtccatgccaggttttcctcttctgggtccggagctcactatagtattcagccctcagtcctcccaggatgttcttcccagcactgctgcctcgtgcggattttcccgtaacctcagtaactggcttcttgtccccctgcttcctaccagggaagccttcctgtccgcgtctgtggtttcccaactctgatatttgctctcaaatgtggtggtgtcctggttctgtgtttatttattttgtgttttctcacacacacaaaaaaaagcctcttcctccaatgcatcaggaggcaccagccctgccagcccttctcactgggctcaccctgccccagcaaccccccggtgccacccttaagccacactgtcttctctgtaagcagcctgccagcagcagccccagcactttgcaatgggcgtgtgtgtggtggtgggtggggggggcttggatccctcctttttcctcccctgccctgcccaggcccagatggccttgactgtaaagcaggtgctgcctgacaggttcttctctccctgtctctggtcattgatccatctctttgtccattcagtatccaaccatcctctccattctcctctggacctcaccactctcagagctgcttgtcctggcagaatctacaattcaccccaactctatgccttacccctcccaacccaacagcatttgcagtttgcaaaatatacagacccaagtcctgaggggactgaggacatgatgctgggcccaagtctcctgctcagggcttctctccaatgccagccctgccactccttcctcaccctccttggagcctcctcctgctgcttgtctatcccaacggccctgctcccctcccttcctgcccttcaccagctttctggacaccatgccctgaggaagggacctttggttttctctaaacatctttgaagggctgaggcagtcagggctggctgccttgtcactctttatttggaagccactcaaaccattcccaagaagagggacctcagctggcaatctggaaacctggcccaggtctgggcagatgtcttcacttctcctaccttcccagtcttgtgatcctgtgatgagcaccaggatggccctgtggtccctagagcacccctcatgctgtagggtcctgcagccccatcctttctctactgggccctggtatcctggctcctctctcagctctgccactgatctctgtgccttagtttacttctctgcacgggggactcaccccaagaccatttccagcagcttcccaggtgatgtggtgccccaaggctgggctttgccagctgtggcccagctccttagtgctgcccaggagacaccaggctgctcagaatgaggtgactgcgggcaccattctcagccagtggttcttgtattgcattccagcagcaggaatatcacctgggaacttgatagaagtgcagattagcagccccacccaagacccactgaattagagcttgtggagtggggccctacaagctggggttttaaggagccctccaaatgattctgacgcataagaatatgccaactgctgatctgggctagccattagtagagcctggggagggactgggactggctaggccaagaacaggtggaaaacaccagccttatctggactcctgagattgggaaccaccaccaacaaaaaccaaccctatagtcgctcctcttggaagaggaagagaagttgaagggcctggagaaagcacacattgtttgtttccctgccctgtgtcttatttcagacatgagaataactgtacagtgtaaacttataaagcgtttttaatggttgtagattggaaataaagtatgtcatatgaaca

SEQ ID NO: 300649 - DNA, 3612 bp, Homo sapiens
  misc_feature (3601)..(3601): n is a, c, g, or t
ggctctttgtcgctctcccctcctatctacgaatgtcccctgctctctgagcctcaccatgaccccaccgaaggtcccactacttcttccatgataatagtaataacaatggttatcatcatcccctgcacatcccgcctaaagcactttactatatagaaaacgtttcccctggccgggcatggtggctcacgcctgaaatcccagctctttgggaggctgaggcgagcggatcagttgaggtcaggagttcaacgccagcctggccaacgtggtgaatccctgtctgtactaaaagtacaaaaaattagctgagcatggtggtgcgtgcctgtaatcccagctactcgggaggctgaggtgggagaatcgcttgagcccaggaggcggaggttgcaggagcagagattgcgccactgcactccagcctggatgacagagtgagacccaatctcaaaaaagaaatcgtttcccaccccacatctccttcagacctctcagggacaactctgggaggcagccttggcaggacatgggttagtgcgcccattttgctgtgaggaaactgaggtacaggtctcatcccagagcatgagaagtcactgagtttagatgagaacttgggtccaactctgtcctgtttgctgtgcaaatccgctgccctgctgggggcttttggtgggtccagaatacccagaatatgctgctggccaacccaggcataaaacaagtccattctagatcactgagccttgtgtattccagagggtgatctgaggtccccattcagcagaattctctgagggcatgttcagaatgtagattcctgggccccaccttgaatttgcatgtttaacaaactctcctggggttgaggggtgggtgcagtggtcacacctgtaatcccaaagtactgggattataggcgtgagccacggcatccagcctcatctttcttttaaccaataaacatgatgctgtatcttaaaaagagcactgagcagggacttaagggatcgagtcctcaaccaaactgatttaattactcaggattttcaaaaagcatcagaggctatttacaatcttaatcataggggttcagtaaaataaaaataagaagtaaaaaagcaagagaaattattctgtaaatctaactggtgtaattcccataatcatgcaattaagttttactcttgagtttcctgacagccattggtaaaaagagaaacacatcaggatttataatttttatcatccaattatgggaagcaagcatgttggccccaggagacgaactcttctactaatttatagcatgtatcctttcatcaagggccactgagccagttggtgagtcaacgggtgaacctaagatgcaaggatgttttccaggtgactatttaaaaaaataaataatccaccaacgtgattgaccttggcgagatcatgtttctagtctatacctcagtttccccatctgtaaagtgaggataatgtcccaccccatgtaactgtggtgaggaccaactgcaacactgtgcctgcgagtctccttggaaaagtgtaaggttctacacaaatggaaagtgatctgatcacactcagtgtccccagcccagcctttcagtgccctggccctggggtgggggacaatactctcctcacccccttcactagtcttcatgaatagcaaggaggccataacataatttggtctaaaccccttcctttttaaaagaatgatggcaaaatgtgcataacattaaatttaccattttaaagatttctaagtgtctcgaagtacatttgcaatgtgtaactgccacctccagaactttttcatcatcctaaactgaaactctgtacccactaaacagtaactccccactccccctgtccccagtccctggtaacctctattctacttttttttttctctgtggattggcctattctaggtatctcttttaagtagaatcatatagtatttgtccttttgtgtccagccccctcattttttgagatgaggaatcaggcccagagaaggcagtggctcacccaaggtcacatcgcaaaccagaggcagagccaagaccagaacccaggtttcctgactcctaacaggtcttgcatccccagtagtgaatgagacactgctttgactttctgtaatcttggtttagccccttcctttctctgggctcagtctgcttcccaccactcacccattctttctttatcatctccctccaaagcctcttgtcctcctgcctcctcttctccttggctggttcctgccagcaaatggagtggccctggtccatgccaggttttcctcttctgggtccggagctcactatagtattcagccctcagtcctcccaggatgttcttcccagcactgctgcctcgtgcggattttcccgtaacctcagtaactggcttcttgtccccctgcttcctaccagggaagccttcctgtccgcgtctgtggtttcccaactctgatatttgctctcaaatgtggtggtgtcctggttctgtgtttatttattttgtgttttctcacacacacaaaaaaaagcctcttcctccaatgcatcaggaggcaccagccctgccagcccttctcactgggctcaccctgccccagcaaccccccggtgccacccttaagccacactgtcttctctgtaagcagcctgccagcagcagccccagcactttgcaatgggcgtgtgtgtggtggtgggtggggggggcttggatccctcctttttcctcccctgccctgcccaggcccagatggccttgactgtaaagcaggtgctgcctgacaggttcttctctccctgtctctggtcattgatccatctctttgtccattcagtatccaaccatcctctccattctcctctggacctcaccactctcagagctgcttgtcctggcagaatctacaattcaccccaactctatgccttacccctcccaacccaacagcatttgcagtttgcaaaatatacagacccaagtcctgaggggactgaggacatgatgctgggcccaagtctcctgctcagggcttctctccaatgccagccctgccactccttcctcaccctccttggagcctcctcctgctgcttgtctatcccaacggccctgctcccctcccttcctgcccttcaccagctttctggacaccatgccctgaggaagggacctttggttttctctaaacatctttgaagggctgaggcagtcagggctggctgccttgtcactctttatttggaagccactcaaaccattcccaagaagagggacctcagctggcaatctggaaacctggcccaggtctgggcagatgtcttcacttctcctaccttcccagtcttgtgatcctgtgatgagcaccaggatggccctgtggtccctagagcacccctcatgctgtagggtcctgcagccccatcctttctctactgggccctggtatcctggctcctctctcagctctgccactgatctctgtgccttagtttacttctctgcacgggggactcaccccaagaccatttccagcagcaggaggagnacgggtccgag

SEQ ID NO: 300650 - DNA, 356 bp, Homo sapiens
cctatgatccaatgatgatcgaatttcgagctctggtaccccgaaagagacaacaggtgagggtcctgcagtcatgggccctgggggacccccagggcaaggcccatgggagggaagggaccaagggcatccttgggccaactgtccacctctcttgtccactattctctcctttccacttctgtcttcaaaaggctccttcctaggatggatcgggtgctaggacaactgcagtccaatccaccagctctccctgcccctgtgtcttatttcagacatgagaataactgtacagtgtaaacttataaagcgtttttaatggttgtagattggaaataaagtatgtcatatgaaca

SEQ ID NO: 300651 - DNA, 2541 bp, Homo sapiens
ccggcagaacctgttgagaaaggggcatccacagacatctgtgccttctgccacaagaccgtgtccccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagaggtgcggcaagtgtggcgaggtggtccgggaccacatcatcagggccctgggccaggccttccacccctcctgcttcacgtgtgtgacctgcgcccggtgcattggggatgagagctttgccctgggcagccagaacgaggtgtactgcctggacgacttctacaggaaattcgcccccgtctgcagcatctgtgaaaatcccatcatccctcgggatgggaaagatgccttcaaaatcgaatgcatgggaagaaacttccatgaaaattgctacaggtgtgaggactgcaggatcctcctgtctgtcgagcccacggaccaaggctgctaccccctgaacaaccatctcttctgcaagccatgccatgtgaagcggagtgctgcggggtgctgctgagagtgcccgctgggcagtgaacagaccactagccccggctggggcccttccctgacttggtttcccttcctaacctgctcttgcacactttccttctgagcctccatggagaccagcctgcaagccggcccagcctgtccaggatacagtggggctgagcacccccaggccttccactcctctaccctctgggcaccagaaggctcctggaccatgagcttcacccccagaattccctgctgaccctgccccacttccagggaaaagctgggggaggttggacccctctcactgactagctgtctggtaggggtgctaggaccagcctcgcctgtggggttgagctgtttgaggacaaactccaaggtcccttaaaaagtgccttttagaggctgggcatggtggctcacgcttgtaatcccagcactttgggaggccaaggtgggtggatcacctgaggtcaggagttcaagaccagcctggccaacatggtgaaaccctgtctctactaaaaatacaaaaattagccaggcatggtagcaggtgcctgtaatcccagctactggggaaagctgaggcaggagaattgcttcaatctggaaggcagaggttgcagtgagattgcaccattgcattccagcctgggcaacaagagggaaactccgtctcaaaaaaaaaaaaaagtgccttttaggccggatgtggtggctcatgcctgtaatcccagcactttgggaggccaaggcaggcagatcacttgaggtcaggagtttgagaccagcctggccaacacggcaaaaccccgtttctactaaaaatacaaaaattagctgggtgtggtggcgtgcgcctgtaatcccagctactcaggaggctgaggcaggagcattgcttgaacccgggaggcagaggttgcagtgagctgagatggcaccactgcactccagcctgggagacacagcgagactctgtctccaaaaaaaaaagtgctttttgaaaatgttgaggttgaaatgatgggaaccaacattctttggatttagtggggagcataatagcaaacacccccttggttcgcacatgtacaggaatgggacccagttggggcacagccatggacttccccgccctggaatgtgtggtgcaaagtggggccagggcccagacccaagaggagagggtggtccgcagacaccccgggatgtcagcatcccccgacctgccttctggcggcacctcccgggtgctgtgttgagtcagcaggcatggggtgagagcctggtatatgctgggaacagggtgcaggggccaagcgttcctccttcagccttgacttgggccatgcaccccctctcccccaaacacaaacaagcacttctccagtatggtgccaggacaggtgtcccttcagtcctctggttatgacctcaagtcctacttgggccctgcagcccagcctgtgttgtaacctctgcgtcctcaagaccacacctggaagattcttcttccctttgaaggagaatcatcattgttgctttatcacttctaagacattttgtacggcacggacaagttaaacagaatgtgcttccctccctggggtctcacacgctcccacgagaatgccacaggggccgtgcactgggcaggcttctctgtagaaccccaggggcttcggcccagaccacagcgtcttgccctgagcctagagcagggagtcccgaacttctgcattcacagaccacctccacaattgttataaccaaaggcctcctgttctgttatttcacttaaatcaacatgctattttgttttcactcacttctgactttagcctcgtgctgagccgtgtatccatgcagtcatgttcacgtgctagttacgtttttcttcttacacatgaaaataaatgcataagtgttagaa

SEQ ID NO: 300652 - DNA, 3200 bp, Homo sapiens
gcgggccaggacgaatccctccatccgggagcagtggtggcggtggaacaggtggcctggggtgctggaggcaggccaacctggagaggtaggcagtggctacctccactttacagatgaagacactgaggctcaggaggtggcgtgactgctccgggtctcacgcttagtaaacggccgcagaaccctggtcggtttgacgcaagaccctggcggatcccagagccaaacagagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggagacatctgtgccttctgccacaagaccgtgtccccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagaggtgcggcaagtgtggcgaggtggtccgggaccacatcatcagggccctgggccaggccttccacccctcctgcttcacgtgtgtgacctgcgcccggtgcattggggatgagagctttgccctgggcagccagaacgaggtgtactgcctggacgacttctacaggaaattcgcccccgtctgcagcatctgtgaaaatcccatcatccctcgggatgggaaagatgccttcaaaatcgaatgcatgggaagaaacttccatgaaaattgctacaggtgtgaggactgcaggatcctcctgtctgtcgagcccacggaccaaggctgctaccccctgaacaaccatctcttctgcaagccatgccatgtgaagcggagtgctgcggggtgctgctgagagtgcccgctgggcagtgaacagaccactagccccggctggggcccttccctgacttggtttcccttcctaacctgctcttgcacactttccttctgagcctccatggagaccagcctgcaagccggcccagcctgtccaggatacagtggggctgagcacccccaggccttccactcctctaccctctgggcaccagaaggctcctggaccatgagcttcacccccagaattccctgctgaccctgccccacttccagggaaaagctgggggaggttggacccctctcactgactagctgtctggtaggggtgctaggaccagcctcgcctgtggggttgagctgtttgaggacaaactccaaggtcccttaaaaagtgccttttagaggctgggcatggtggctcacgcttgtaatcccagcactttgggaggccaaggtgggtggatcacctgaggtcaggagttcaagaccagcctggccaacatggtgaaaccctgtctctactaaaaatacaaaaattagccaggcatggtagcaggtgcctgtaatcccagctactggggaaagctgaggcaggagaattgcttcaatctggaaggcagaggttgcagtgagattgcaccattgcattccagcctgggcaacaagagggaaactccgtctcaaaaaaaaaaaaaagtgccttttaggccggatgtggtggctcatgcctgtaatcccagcactttgggaggccaaggcaggcagatcacttgaggtcaggagtttgagaccagcctggccaacacggcaaaaccccgtttctactaaaaatacaaaaattagctgggtgtggtggcgtgcgcctgtaatcccagctactcaggaggctgaggcaggagcattgcttgaacccgggaggcagaggttgcagtgagctgagatggcaccactgcactccagcctgggagacacagcgagactctgtctccaaaaaaaaaagtgctttttgaaaatgttgaggttgaaatgatgggaaccaacattctttggatttagtggggagcataatagcaaacacccccttggttcgcacatgtacaggaatgggacccagttggggcacagccatggacttccccgccctggaatgtgtggtgcaaagtggggccagggcccagacccaagaggagagggtggtccgcagacaccccgggatgtcagcatcccccgacctgccttctggcggcacctcccgggtgctgtgttgagtcagcaggcatggggtgagagcctggtatatgctgggaacagggtgcaggggccaagcgttcctccttcagccttgacttgggccatgcaccccctctcccccaaacacaaacaagcacttctccagtatggtgccaggacaggtgtcccttcagtcctctggttatgacctcaagtcctacttgggccctgcagcccagcctgtgttgtaacctctgcgtcctcaagaccacacctggaagattcttcttccctttgaaggagaatcatcattgttgctttatcacttctaagacattttgtacggcacggacaagttaaacagaatgtgcttccctccctggggtctcacacgctcccacgagaatgccacaggggccgtgcactgggcaggcttctctgtagaaccccaggggcttcggcccagaccacagcgtcttgccctgagcctagagcagggagtcccgaacttctgcattcacagaccacctccacaattgttataaccaaaggcctcctgttctgttatttcacttaaatcaacatgctattttgttttcactcacttctgactttagcctcgtgctgagccgtgtatccatgcagtcatgttcacgtgctagttacgtttttcttcttacacatgaaaataaatgcataagtgttagaa

SEQ ID NO: 300653 - DNA, 2207 bp, Homo sapiens
tgtggttgtggcatgaacgcctcccaagcatgggttcctttgcttctaggaaattcgcccccgtctgcagcatctgtgaaaatcccatcatccctcgggatgggaaagatgccttcaaaatcgaatgcatgggaagaaacttccatgaaaattgctacaggtgtgaggactgcaggatcctcctgtctgtcgagcccacggaccaaggctgctaccccctgaacaaccatctcttctgcaagccatgccatgtgaagcggagtgctgcggggtgctgctgagagtgcccgctgggcagtgaacagaccactagccccggctggggcccttccctgacttggtttcccttcctaacctgctcttgcacactttccttctgagcctccatggagaccagcctgcaagccggcccagcctgtccaggatacagtggggctgagcacccccaggccttccactcctctaccctctgggcaccagaaggctcctggaccatgagcttcacccccagaattccctgctgaccctgccccacttccagggaaaagctgggggaggttggacccctctcactgactagctgtctggtaggggtgctaggaccagcctcgcctgtggggttgagctgtttgaggacaaactccaaggtcccttaaaaagtgccttttagaggctgggcatggtggctcacgcttgtaatcccagcactttgggaggccaaggtgggtggatcacctgaggtcaggagttcaagaccagcctggccaacatggtgaaaccctgtctctactaaaaatacaaaaattagccaggcatggtagcaggtgcctgtaatcccagctactggggaaagctgaggcaggagaattgcttcaatctggaaggcagaggttgcagtgagattgcaccattgcattccagcctgggcaacaagagggaaactccgtctcaaaaaaaaaaaaaagtgccttttaggccggatgtggtggctcatgcctgtaatcccagcactttgggaggccaaggcaggcagatcacttgaggtcaggagtttgagaccagcctggccaacacggcaaaaccccgtttctactaaaaatacaaaaattagctgggtgtggtggcgtgcgcctgtaatcccagctactcaggaggctgaggcaggagcattgcttgaacccgggaggcagaggttgcagtgagctgagatggcaccactgcactccagcctgggagacacagcgagactctgtctccaaaaaaaaaagtgctttttgaaaatgttgaggttgaaatgatgggaaccaacattctttggatttagtggggagcataatagcaaacacccccttggttcgcacatgtacaggaatgggacccagttggggcacagccatggacttccccgccctggaatgtgtggtgcaaagtggggccagggcccagacccaagaggagagggtggtccgcagacaccccgggatgtcagcatcccccgacctgccttctggcggcacctcccgggtgctgtgttgagtcagcaggcatggggtgagagcctggtatatgctgggaacagggtgcaggggccaagcgttcctccttcagccttgacttgggccatgcaccccctctcccccaaacacaaacaagcacttctccagtatggtgccaggacaggtgtcccttcagtcctctggttatgacctcaagtcctacttgggccctgcagcccagcctgtgttgtaacctctgcgtcctcaagaccacacctggaagattcttcttccctttgaaggagaatcatcattgttgctttatcacttctaagacattttgtacggcacggacaagttaaacagaatgtgcttccctccctggggtctcacacgctcccacgagaatgccacaggggccgtgcactgggcaggcttctctgtagaaccccaggggcttcggcccagaccacagcgtcttgccctgagcctagagcagggagtcccgaacttctgcattcacagaccacctccacaattgttataaccaaaggcctcctgttctgttatttcacttaaatcaacatgctattttgttttcactcacttctgactttagcctcgtgctgagccgtgtatccatgcagtcatgttcacgtgctagttacgtttttcttcttacacatgaaaataaatgcataagtgttagaa

SEQ ID NO: 300654 - DNA, 2222 bp, Homo sapiens
tcctgccaagaagaaacagacatctctgcagtcccatagcaacgggactgaaattgctcaggaggaaattcgcccccgtctgcagcatctgtgaaaatcccatcatccctcgggatgggaaagatgccttcaaaatcgaatgcatgggaagaaacttccatgaaaattgctacaggtgtgaggactgcaggatcctcctgtctgtcgagcccacggaccaaggctgctaccccctgaacaaccatctcttctgcaagccatgccatgtgaagcggagtgctgcggggtgctgctgagagtgcccgctgggcagtgaacagaccactagccccggctggggcccttccctgacttggtttcccttcctaacctgctcttgcacactttccttctgagcctccatggagaccagcctgcaagccggcccagcctgtccaggatacagtggggctgagcacccccaggccttccactcctctaccctctgggcaccagaaggctcctggaccatgagcttcacccccagaattccctgctgaccctgccccacttccagggaaaagctgggggaggttggacccctctcactgactagctgtctggtaggggtgctaggaccagcctcgcctgtggggttgagctgtttgaggacaaactccaaggtcccttaaaaagtgccttttagaggctgggcatggtggctcacgcttgtaatcccagcactttgggaggccaaggtgggtggatcacctgaggtcaggagttcaagaccagcctggccaacatggtgaaaccctgtctctactaaaaatacaaaaattagccaggcatggtagcaggtgcctgtaatcccagctactggggaaagctgaggcaggagaattgcttcaatctggaaggcagaggttgcagtgagattgcaccattgcattccagcctgggcaacaagagggaaactccgtctcaaaaaaaaaaaaaagtgccttttaggccggatgtggtggctcatgcctgtaatcccagcactttgggaggccaaggcaggcagatcacttgaggtcaggagtttgagaccagcctggccaacacggcaaaaccccgtttctactaaaaatacaaaaattagctgggtgtggtggcgtgcgcctgtaatcccagctactcaggaggctgaggcaggagcattgcttgaacccgggaggcagaggttgcagtgagctgagatggcaccactgcactccagcctgggagacacagcgagactctgtctccaaaaaaaaaagtgctttttgaaaatgttgaggttgaaatgatgggaaccaacattctttggatttagtggggagcataatagcaaacacccccttggttcgcacatgtacaggaatgggacccagttggggcacagccatggacttccccgccctggaatgtgtggtgcaaagtggggccagggcccagacccaagaggagagggtggtccgcagacaccccgggatgtcagcatcccccgacctgccttctggcggcacctcccgggtgctgtgttgagtcagcaggcatggggtgagagcctggtatatgctgggaacagggtgcaggggccaagcgttcctccttcagccttgacttgggccatgcaccccctctcccccaaacacaaacaagcacttctccagtatggtgccaggacaggtgtcccttcagtcctctggttatgacctcaagtcctacttgggccctgcagcccagcctgtgttgtaacctctgcgtcctcaagaccacacctggaagattcttcttccctttgaaggagaatcatcattgttgctttatcacttctaagacattttgtacggcacggacaagttaaacagaatgtgcttccctccctggggtctcacacgctcccacgagaatgccacaggggccgtgcactgggcaggcttctctgtagaaccccaggggcttcggcccagaccacagcgtcttgccctgagcctagagcagggagtcccgaacttctgcattcacagaccacctccacaattgttataaccaaaggcctcctgttctgttatttcacttaaatcaacatgctattttgttttcactcacttctgactttagcctcgtgctgagccgtgtatccatgcagtcatgttcacgtgctagttacgtttttcttcttacacatgaaaataaatgcataagtgttagaa

SEQ ID NO: 300655 - DNA, 1010 bp, Homo sapiens
gcgggccaggacgaatccctccatccgggagcagtggtggcggtggaacaggtggcctggggtgctggaggcaggccaacctggagaggtaggcagtggctacctccactttacagatgaagacactgaggctcaggaggtggcgtgactgctccgggtctcacgcttagtaaacggccgcagaaccctggtcggtttgacgcaagaccctggcggatcccagagccaaacagagctggcctgaacctccaggacttcagcccttctaggagaatctgatcccaggtgagggaggtcacttggggtgtggcccagcaggcaggcgggatgctgtgttgagtcagcaggcatggggtgagagcctggtatatgctgggaacagggtgcaggggccaagcgttcctccttcagccttgacttgggccatgcaccccctctcccccaaacacaaacaagcacttctccagtatggtgccaggacaggtgtcccttcagtcctctggttatgacctcaagtcctacttgggccctgcagcccagcctgtgttgtaacctctgcgtcctcaagaccacacctggaagattcttcttccctttgaaggagaatcatcattgttgctttatcacttctaagacattttgtacggcacggacaagttaaacagaatgtgcttccctccctggggtctcacacgctcccacgagaatgccacaggggccgtgcactgggcaggcttctctgtagaaccccaggggcttcggcccagaccacagcgtcttgccctgagcctagagcagggagtcccgaacttctgcattcacagaccacctccacaattgttataaccaaaggcctcctgttctgttatttcacttaaatcaacatgctattttgttttcactcacttctgactttagcctcgtgctgagccgtgtatccatgcagtcatgttcacgtgctagttacgtttttcttcttacacatgaaaataaatgcataagtgttagaa

SEQ ID NO: 300656 - DNA, 2025 bp, Homo sapiens
gcgggccaggacgaatccctccatccgggagcagtggtggcggtggaacaggtggcctggggtgctggaggcaggccaacctggagaggtaggcagtggctacctccactttacagatgaagacactgaggctcaggaggtggcgtgactgctccgggtctcacgcttagtaaacggccgcagaaccctggtcggtttgacgcaagaccctggcggatcccagagccaaacagagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggagacatctgtgccttctgccacaagaccgtgtccccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagaggtgcggcaagtgtggcgaggtggtccgggaccacatcatcagggccctgggccaggccttccacccctcctgcttcacgtgtgtgacctgcgcccggtgcattggggatgagagctttgccctgggcagccagaacgaggtgtactgcctggacgacttctacaggaaattcgcccccgtctgcagcatctgtgaaaatcccatcatccctcgggatgggaaagatgccttcaaaatcgaatgcatgggaagaaacttccatgaaaattgctacaggtgtgaggactgcaggatcctcctgtctgtcgagcccacggaccaaggctgctaccccctgaacaaccatctcttctgcaagccatgccatgtgaagcggagtgctgcggggtgctgctgagagtgcccgctgggcagtgaacagaccactagccccggctggggcccttccctgacttggtttcccttcctaacctgctcttgcacactttccttctgagcctccatggagaccagcctgcaagccggcccagcctgtccaggatacagtggggctgagcacccccaggccttccactcctctaccctctgggcaccagaaggctcctggaccatgagcttcacccccagaattccctgctgaccctgccccacttccagggaaaagctgggggaggttggacccctctcactgactagctgtctggtaggggtgctaggaccagcctcgcctgtggggttgagctgtttgaggacaaactccaaggtcccttaaaaagtgccttttagaggctgggcatggtggctcacgcttgtaatcccagcactttgggaggccaaggtgggtggatcacctgaggtcaggagttcaagaccagcctggccaacatggtgaaaccctgtctctactaaaaatacaaaaattagccaggcatggtagcaggtgcctgtaatcccagctactggggaaagctgaggcaggagaattgcttcaatctggaaggcagaggttgcagtgagccaagatcccgccactgcacttcagcctgggcaacagtgtgacacaccatctctgataaataagcaaacgaacaaaataaaccaaacacataagtatgcccactgatttccttattgtctgtggtgactct

SEQ ID NO: 300657 - DNA, 753 bp, Homo sapiens
gcgggccaggacgaatccctccatccgggagcagtggtggcggtggaacaggtggcctggggtgctggaggcaggccaacctggagaggtaggcagtggctacctccactttacagatgaagacactgaggctcaggaggtggcgtgactgctccgggtctcacgcttagtaaacggccgcagaaccctggtcggtttgacgcaagaccctggcggatcccagagccaaacagagctggcctgaacctccaggacttcagcccttctaggagaatctgatcccaggtgagggaggtcacttggggtgtggcccagcaggcaggcgggactccagactgggaacggaagtcagccctgctggggctgggagctgaagcatctgttccttcctcgcgggtgtgagacaaggaagagtgatcattgccacaccaggagctgaagccatggcctcaaagcctgagaagagggtggcatcgtctgtctttatcaccctggcacccccgcgccgcgatgtggccgtggcggaggaagtgaggcaggcagtttgtgaggcccggcgtggccgcccctgggaggctcctgcccccatgaagacacccgaggctggcttggcggggaggcccagcccctggacaacccctggcagagctgcagccacagtgccggctgcacctatgcagctcttcaatggaggatgcccaccccctcctcctgtcctggatggtgaggacgtgcttcctgacctggacctcc

SEQ ID NO: 300658 - DNA, 1826 bp, Homo sapiens
caagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300659 - DNA, 1736 bp, Homo sapiens
ttggcctcgaggccaagattcggcacgaggaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300660 - DNA, 1674 bp, Homo sapiens
cccgcagcggtccgcactcggggaggcgggagggtgacggcggtgctgcgaggtcggcgcgcagctccgccgcgggtcgctcgggcgctgtccaggcggagccggccccgcccgggctgcagccatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300661 - DNA, 1947 bp, Homo sapiens
cccgcagcggtccgcactcggggaggcgggagggtgacggcggtgctgcgaggtcggcgcgcagctccgccgcgggtcgctcgggcgctgtccaggcggagccggccccgcccgggctgcagccatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggtatggtccaagcctgaggctcctggcaccaccgggtgctgtcaagggaacaggccaagagcaccaggggcagggctgccactagcaggtggtcacaggttcctgttccccaggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacgcaagtatgaccagaagccaggacaaagctggcagggggagatcccaagcctagccttgggtgagaccaagccctacttttgttcttctataggccctgggctcaatctaagcgggtgctggggtcctcctcgccttatcaacccttttctccctttagcaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300662 - DNA, 1294 bp, Homo sapiens
tttaacttgtatacagtacagtttcaaacaaaattggggcaactttgtacttcgtaccttattaaaactggggcgaacacagcgtgtttggtttgatcttgtcttcataggatcttctggctgattccttctctggatgagtcctgagaatttctagaatctcgggagagtaaaggagggtctggagccttctctatgtacaaggaaatcccagttttgttaaaaacttgccaaaggcttggtgatataactccaaagacaaatccacagattcctttcaggtacttctttgggattctgtgaagaattgtggctgtacactaggatgtttaataggaaggaagctccttcctttatgacatcaccagacagagaggtagctaaggggattatttgagacactcttagaacaacagccacttttgtgggagcccaagaaacagcagctttaaaacagggtaaatattcaggcatcattaggatcctgaatacaagccagccagtaaaatacgggatctactcagaagggcacaatctatcagatggtcaagacaaataaacctggggccaaggtagcggtttcagcacagagagggtctgaggttactactaacacatcccctcagcagggacatgggtacgttcttgcctcaagccatcgaagtgctgcagtctccctgaacccttcccaccgaagatcagaagctgcacatcccaccactccccattcggcatcagactaccctcgatctgtctccctccagtcaggacctggacactatgcagtacccactcctcggggaaccgagactggaccaagaacagaatcatcccgccattcctctccccatctaaagagccagaagactcagacactggcttcccatgcttcaagcagacaatggaaagttagtccacccagagaggaagcagcacgaagaggcagtgagagcaagtcagggcgcgaggtcggccatcatgcttcatcaatcccagatgccaaatctactcatcagttgagttttcaagaccagaagaataacttacaatcacaaatcttagaagatgacccaccatccaaggtccagaacccccaaggagtcagagttccccgtaggattttgtcttacccaaaggatgaagcagtacaaactgagcccatccaaagaattacgactactagtgagatcagatctccaaggagtccctctctcctagagcacggaagcagctgtgtctctgcagactatcagacagcccagagaagggtccctgtagaagaatcagaaacagg

SEQ ID NO: 300663 - DNA, 276 bp, Homo sapiens
aaggactctccaaaagtccccattttgatgcctgtgcctattccagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300664 - DNA, 1746 bp, Homo sapiens
cccgcagcggtccgcactcggggaggcgggagggtgacggcggtgctgcgaggtcggcgcgcagctccgccgcgggtcgctcgggcgctgtccaggcggagccggccccgcccgggctgcagccatggggccagtaccaacttcatttggaaaacgcagaggaggcccacaaacactgcctgcctcaccaggagggatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300665 - DNA, 1702 bp, Homo sapiens
acaatgagagttgggggaaacagttcctcttctgagctgaggatggggtagaacaggcttctacagaggagtcagtccattctctgccttccactccctgtgggtcatggttcaggccaggccctctcgtgcactgccggctctgggcagaggggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300666 - DNA, 1939 bp, Homo sapiens
caagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggtatggtccaagcctgaggctcctggcaccaccgggtgctgtcaagggaacaggccaagagcaccaggggcagggctgccactagcaggtggtcacaggttcctgttccccaggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300667 - DNA, 1730 bp, Homo sapiens
caagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300668 - DNA, 2196 bp, Homo sapiens
caagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggtagagcctccagccctgcctttgcctttcagtgggctgctgcaggaagaccgggggcagggagcagagtgtgtgtgtgtgtgtgtgtgtgtgtgtgtgtgtgtgtgtgtgtgtgtgtgtgtgtatctgggacctatttcagtcctgtgtcagccctagctccaagatatctgcccccaagggcactggaaatttgcagtttcagcaagggcaggaggcccagctggtggcctcagatgggaactcacagaagtctggcactgcttttttaaggctggggcaaaggcctgaaagggagagaagattggcgctgggtgccggggcccctttggctcctcaccgtgatgcattctgccttcctgtctactaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300669 - DNA, 1377 bp, Homo sapiens
cccgcagcggtccgcactcggggaggcgggagggtgacggcggtgctgcgaggtcggcgcgcagctccgccgcgggtcgctcgggcgctgtccaggcggagccggccccgcccgggctgcagccatggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300670 - DNA, 2044 bp, Homo sapiens
cccgcagcggtccgcactcggggaggcgggagggtgacggcggtgctgcgaggtcggcgcgcagctccgccgcgggtcgctcgggcgctgtccaggcggagccggccccgcccgggctgcagccatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggtagagcctccagccctgcctttgcctttcagtgggctgctgcaggaagaccgggggcagggagcagagtgtgtgtgtgtgtgtgtgtgtgtgtgtgtgtgtgtgtgtgtgtgtgtgtgtgtgtatctgggacctatttcagtcctgtgtcagccctagctccaagatatctgcccccaagggcactggaaatttgcagtttcagcaagggcaggaggcccagctggtggcctcagatgggaactcacagaagtctggcactgcttttttaaggctggggcaaaggcctgaaagggagagaagattggcgctgggtgccggggcccctttggctcctcaccgtgatgcattctgccttcctgtctactaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300671 - DNA, 1529 bp, Homo sapiens
caagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctggggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300672 - DNA, 1905 bp, Homo sapiens
caagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggcaaaaaaaaaactaaagaaaaaagaatatatactataaagtataagaaatatggaggtcaactcttatactgtagcgtaa

SEQ ID NO: 300673 - DNA, 1449 bp, Homo sapiens
cccgcagcggtccgcactcggggaggcgggagggtgacggcggtgctgcgaggtcggcgcgcagctccgccgcgggtcgctcgggcgctgtccaggcggagccggccccgcccgggctgcagccatggggccagtaccaacttcatttggaaaacgcagaggaggcccacaaacactgcctgcctcaccaggagggatggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300674 - DNA, 1642 bp, Homo sapiens
caagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctggggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggtatggtccaagcctgaggctcctggcaccaccgggtgctgtcaagggaacaggccaagagcaccaggggcagggctgccactagcaggtggtcacaggttcctgttccccaggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300675 - DNA, 1771 bp, Homo sapiens
caagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300676 - DNA, 1986 bp, Homo sapiens
caagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacgcaagtatgaccagaagccaggacaaagctggcagggggagatcccaagcctagccttgggtgagaccaagccctacttttgttcttctataggccctgggctcaatctaagcgggtgctggggtcctcctcgccttatcaacccttttctccctttagcaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300677 - DNA, 1672 bp, Homo sapiens
  misc_feature (1630)..(1630): n is a, c, g, or t
  misc_feature (1654)..(1654): n is a, c, g, or t
caagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgcttcccaaaatcntctcttttttctgtcatgccgggncctcccaacaccaaatat

SEQ ID NO: 300678 - DNA, 1855 bp, Homo sapiens
caagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagcgcaagtatgaccagaagccaggacaaagctggcagggggagatcccaagcctagccttgggtgagaccaagccctacttttgttcttctataggccctgggctcaatctaagcgggtgctggggtcctcctcgccttatcaacccttttctccctttagcaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300679 - DNA, 1831 bp, Homo sapiens
caagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300680 - DNA, 1668 bp, Homo sapiens
caagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300681 - DNA, 1696 bp, Homo sapiens
caagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctactgccacttcgccttacatccctgctgactgcccagagactcagaggaaataaagtttaataaatctgtaggtggc

SEQ ID NO: 300682 - DNA, 1714 bp, Homo sapiens
caagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacgcaacaaactgactcgggaaagtggtaccgacttccccatccctgctgtcccaccagggacagatccagaaactgagaagcttatccgagagaaagatgaggagctgcggcggatgcaggtgggaacctatgatttcttgccttagatgtgaactttagaggtggcctggagaaccttgtgtctacctcaaaaaaaaaatgacaaaaaaaatagcag

SEQ ID NO: 300683 - DNA, 1701 bp, Homo sapiens
caagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacgcaacaaactgactcgggaaagtggtaccgacttccccatccctgctgtcccaccagggacagatccagaaactgagaagcttatccgagagaaagatgaggagctgcggcggatgcaggagatgctactgccacttcgccttacatccctgctgactgcccagagactcagaggaaataaagtttaataaatctgtaggtggc

SEQ ID NO: 300684 - DNA, 1861 bp, Homo sapiens
cccgcagcggtccgcactcggggaggcgggagggtgacggcggtgctgcgaggtcggcgcgcagctccgccgcgggtcgctcgggcgctgtccaggcggagccggccccgcccgggctgcagccatggggccagtaccaacttcatttggaaaacgcagaggaggcccacaaacactgcctgcctcaccaggagggatggtaagacgcttggcccctccttccctcagcctgacaaggggcagtccctggccctttcccaaagggaccccagagagggggaggcccagcccaccatcctgcccggtgggattagctatatccttctgcccctgggacaggaaccatgggaaagcttcctcctgctgcatctacccgctccctccccaccagccaggtccctctgcagtgtgtgggggtgggggcacccatccctgccacctgcctgtagtgggaagagaaacagtaaccccagccagcctccctggaggtgcccaggtaggaagtttttgatgcttggctctgaagatgtaatctcttctcctgacattgttgccagagcctgccacaaataacgtaagggtgtcaggacctctaggccacacaccgtcctctcctctcagtctggaagccccacagcctttgccctctgcattgggggacacaaactgtttacagcagggggggatcactgaccagcctgtggggcgggatgttggctgtgggcagcctccagaagggagctccctgggccccctgggatcagaagctttcaggtttggtagggccaaccttttgggctcttgtctctcaagctgtgtccaggcagaggcccaagccttggccaggaagtcttggtgaccctgtgaccttcccccaacgggggttcctgagagaggcctgtccttattcctttcccccacttctccccacatggtggatggatggactgattgttctagggatggaagcctagggaagcactgattgtccccagtgccaagcccagcaggggctagaggggctttttctgccacacactaacttcagttcagctgaggtcttggtgctttcggcttgtccgaggccacactgttcttctctaattaaagacacacccccctccaccccaaccaccatcaccaaagtccccatcctcaggcccctgccctcaagccagccaagttcttaggctgactggttcagatcagactcctctatgagggtctctttgtcaaaggaggtcagtgtcctagctgctttgggaatcagtgggggagacccccccaacccaggtatgccagggggtttaaatttacatgtgaaaagaatgacaggccaacattaatgaccatcctgtgacttgggatgcaccttctcttctcaggttcaaagcagcttaaggtatctatcatctgggagtgctttctctccccagcctcgctgggaggcaaggaagggccattcacaactgaacattaaggtcctcaaattaagacactatccagactcacaaaagatgtttccacccaaccagaaacagtggacccctgacccctagttgagtgcacacttccaaccaggccccttaatttatctcccacctaaatggcagctctgaagcttctgggctgccagcctcccattgccttgaacccgtgctcctcagagaccaagtgctaacagctcccctgttgacactatggaagccatggagtgatctaattgatacaggttgctataagtcagaggtcaggtgtcctagggtaaggggagtccctggagcaaagtcttctctgtggctgatgctccctgcagggaaatttaggagcagatttctgaaacagtgacgttcctcacagg

SEQ ID NO: 300685 - DNA, 1155 bp, Homo sapiens
caagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaaggtaaggaaaggagaggacaatcaggcagacttgccttgggaaattaaactcactccagagtctgggggatggggctctcccccacatgcaggaaaccatggcctcctagagagactgacagcagctctccataggcctaactgcctggcagcccaccagccagctccctaaagatttgggtgctgaagcagggcagagaccagagccttgctctctgaatgagtctctgacccccaaggattccaggaatccaagaaaaaaaccgggagcagagaagaggctggggccagagccaacagccaccggcatttcctgtgttgggaaatgtactccttgctggttcccagagaacagtcccccagacagcttgggagtggagaagggggcagtgtggatta

SEQ ID NO: 300686 - DNA, 1180 bp, Homo sapiens
caagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggtagagcctccagccctgcctttgcctttcagtgggctgctgcaggaagaccgggggcagggagcagagtgtgtgtgtgtgtgtgtgtgtgtgtgtgtgtgtgtgtgtgtgtgtgtgtgtgtgtatctgggacctatttcagtcctgtgtcagccctagctccaagatatctgcccccaagggcactggaaatttgcagtttcagcaagggcaggaggcccagctggtggcctcagatgggaactcacagaagtctggcactgcttttttaaggctggggcaaaggcctgaaagggagagaagattggcgctgggtgccggggcccctttggctcctcaccgtgatgcattctgccttcctgtctactaggatgacaaggagtatgtgggctttgcaaccctccccaaccaagtccaccgaaagtccgtgaagaaaggctttgactttaccctcatggtggcagctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 300687 - DNA, 442 bp, Homo sapiens
actgacacctcccgaagtggaccacaagaaacgcaaagtgagggaagctggtggtgggaggggatcaggtgggcttctagaaaggatgtggtccccagaactgtgggcccctcatctgtttgtcagatccgggaggagattgagcattttggaatcaagatctatcaattcccagactgtgactctgatgaggatgaggacttcaaattgcaggaccaagccctaaaggtggggccactctagggcatcccattcctatcttatttcttccgggtagaaaaagggagtagaattctatattcaggctatcagggtgggaaaggaccctggcttcctagaatgaagcagagaagatgacgatacaggtggaaagaaagaggtgagaacagagggtgctgacaggcacccctaacctcttccaggaaagcatcccatttgcagt

SEQ ID NO: 300688 - DNA, 5608 bp, Homo sapiens
agggcgttggggcagctcctgtgacagacggagctggagcggcggggcggcggcggagtccggcggccgggagagcgagtgagcgagcggaggagcagcgacacgggagtctagggagcgagaaggagaaggaggggagcgctcgggcgcgagcgagagaaaccgcgagcgccgagcttggactcgagccccggaacggctgaggagcccgcccgctcacctcccctccccctccccgggcccgggcccagcgcgccatcctcccccctccttccctccctccctccttcctccctcccctctccctccccctcccccgccggtggatgggagtgaaggacggaagaggccctgcggaggcggcggtgcagcgctccggtggaatgaatcttacttgttgaatatcttctggttactagttggattcatttgtgaaagaatcattttcccctgtgtggaagacacttagtggcatatttaaattataagtccacggatcaaaaagctttttgatttcccaaaggagggacataccactatatcagataagcttgacattacagccaagatggtgctgtcccagagacaacgagatgaactaaatcgagctatagcagattatcttcgttcaaatggctatgaagaggcatattcagtttttaaaaaggaagctgaattagatgtgaatgaagaattagataaaaagtatgctggtcttttggaaaaaaaatggacatctgttattagattacaaaagaaggttatggaattagaatcaaagctaaatgaagcaaaagaagaatttacgtcaggtggacctcttggtcagaaacgagacccaaaagaatggattccccgtccgccagaaaaatatgcattgagtggtcacaggagtccagtcactcgagtcattttccatcctgtgttcagtgttatggtctctgcttcagaggatgctacaattaaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgagactaaaaaaagtggtaaacctgggccattcttgctgtctggatccagagacaagactattaagatgtgggatgtcagtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtgggtaagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaagaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaactattaaatgcctata

SEQ ID NO: 300689 - DNA, 674 bp, Homo sapiens
tactactactaaattcgcggccggtcgaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaactattaaatgcctata

SEQ ID NO: 300690 - DNA, 200 bp, Homo sapiens
tactactactaaattcgcggccggtcgagtgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaactattaaatgcctata

SEQ ID NO: 300691 - DNA, 703 bp, Homo sapiens
ttattcacctcttaattgtcagtattggtggaagagcataccatgtagatagtccagggataagccacagtagttgagagtgctttctattaggaagttttaagtatcttttagtactttacataaaatatttgtatgagtattttttggtaagaaaaactgccaggtcatttatctgtatttgagttaaaaatggttttgtttgtgttttaatttttgttagttgggaaactgaagtccagagagagtaggtcgagtgaaaacgagcccagattctcttgctcacttaagtgaaatgagctgagcgcacagaccccatgccctcgttcattatttcccgggtcttgttgtgggaactgttttctgaggcagtatgttttgtggaaagagagtaatttgctttggagtcagacacctgggttcaaattcctacttgtctacttacggtattagaaaatttaaacctctttcatctgcaaaacagaggtaataataccagagtcatagagttgtcatgaggataagatgaagtcataagataaatcatcttggtgtagtacctgccacataggagatgctcattacttagggatttttgttgtttctttatacatgatgacatttgaatgttgggattttgtacaaggaacacgttaacacatgagtaaactgtgtttacctagagggcataatttgaaggttg

SEQ ID NO: 300692 - DNA, 495 bp, Homo sapiens
ttattcacctcttaattgtcagtattggtggaagagcataccatgtagatagtccagggataagccacagtagttgagagtgctttctattaggaagttttaagtatcttttagtactttacataaaatatttgtatgagtattttttggtaagaaaaactgccaggtcatttatctgtatttgagttaaaaatggttttgtttgtgttttaatttttgttagttgggaaactgaagtccagagagagtaggtcgagtgaaaacgagcccagattctcttgctcacttaagtgaaatgagctgagcgcacagaccccatgccctcgttcattatttcccgggtcttgttgtgggaactgttttctgaggcagtatgttttgtggaaagagagtaatttgctttggagtcagacacctgggtttggtttaatccacatcaacaaccgactaatccccacccaacaatgactaatcaaactaaatcaaacaatgata

SEQ ID NO: 300693 - DNA, 477 bp, Homo sapiens
agggcgttggggcagctcctgtgacagacggagctggagcggcggggcggcggcggagtccggcggccgggagactgagcgcacagaccccatgccctcgttcattatttcccgggtcttgttgtgggaactgttttctgaggcagtatgttttgtggaaagagagtaatttgctttggagtcagacacctgggttcaaattcctacttgtctacttacggtattagaaaatttaaacctctttcatctgcaaaacagaggtaataataccagagtcatagagttgtcatgaggataagatgaagtcataagataaatcatcttggtgtagtacctgccacataggagatgctcattacttagggatttttgttgtttctttatacatgatgacatttgaatgttgggattttgtacaaggaacacgttaacacatgagtaaactgtgtttacctagagggcataatttgaaggttg

SEQ ID NO: 300694 - DNA, 5649 bp, Homo sapiens
agggcgttggggcagctcctgtgacagacggagctggagcggcggggcggcggcggagtccggcggccgggagagcgagtgagcgagcggaggagcagcgacacgggagtctagggagcgagaaggagaaggaggggagcgctcgggcgcgagcgagagaaaccgcgagcgccgagcttggactcgagccccggaacggctgaggagcccgcccgctcacctcccctccccctccccgggcccgggcccagcgcgccatcctcccccctccttccctccctccctccttcctccctcccctctccctccccctcccccgccggtggatgggagtgaaggacggaagaggccctgcggaggcggcggtgcagcgctccggtggaatgaatcttacttgttgaatatcttctggttactagttggattcatttgtgaaagaatcattttcccctgtgtggaagacacttagtggcatatttaaattataagtccacggatcaaaaagctttttgatttcccaaaggagggacataccactatatcagataagcttgacattacagccaagatggtgctgtcccagagacaacgagatgaactaaatcgagctatagcagattatcttcgttcaaatggctatgaagaggcatattcagtttttaaaaaggaagctgaattagatgtgaatgaagaattagataaaaagtatgctggtcttttggaaaaaaaatggacatctgttattagattacaaaagaaggttatggaattagaatcaaagctaaatgaagcaaaagaagaatttacgtcaggtggacctcttggtcagaaacgagacccaaaagaatggattccccgtccgccagaaaaatatgcattgagtggtcacaggagtccagtcactcgagtcattttccatcctgtgttcagtgttatggtctctgcttcagaggatgctacaattaaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgagactaaaaaaagtggtaaacctgggccattcttgctgtctggatccagagacaagactattaagatgtgggatgtcagtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtgggtaagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatggttccccagttttcaggttaatctctaaaaaattgggggccaacaacacaaattttgggcgtttccccttgcgatagaaggacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaagaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaactattaaatgcctata

SEQ ID NO: 300695 - DNA, 5476 bp, Homo sapiens
cacgagatctggtcgtttaaaagtgtgtagcacctccctgctccctctttcttcctcctgcttctgccatggaaaatgcctccctcccgctttgccttctgccatgattgtaagttccctgaggcctccccagaaacgtgtcaccatgcttcctgtacggcctgtggaactgtgaagcaattaaacctcttttctgtataaattacccagtctcaggtatttccttatagcaatgagagaacagatgaatacaaccagaggccaaatacatatttcttattacacagcatcatactttgcttcacatgtgtataaccaaggatgtttttgcttgtcttatatggtatgaccagcttggcagtggatctaaccttttaggacttttgctactaactctgcttggtttctgtttgtgtgtgacaatgtgattcaagcagatgttatagtctggtgaacgccaggtgtactgtactggagaaaatagaaaaagtcaggggctggtttgatatcttgtggtcttcctgcatgtactatatgccaggagacttacttcatagtaagacatactatgaagccactagaaattgtttttaaagactagtttagtgacatgatgttaagaagagtggcaaggtacaaatgcctataaatagaccagaatgaaaatatacttaaatgtagtggacctcttggtcagaaacgagacccaaaagaatggattccccgtccgccagaaaaatatgcattgagtggtcacaggagtccagtcactcgagtcattttccatcctgtgttcagtgttatggtctctgcttcagaggatgctacaattaaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgagactaaaaaaagtggtaaacctgggccattcttgctgtctggatccagagacaagactattaagatgtgggatgtcagtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtgggtaagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaagaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaactattaaatgcctata

SEQ ID NO: 300696 - DNA, 5286 bp, Homo sapiens
acggtgccaacgggacgccgcggtcggccgcatgagcgcaaaagcagggcagcgaggtggaatgaatcttacttgttgaatatcttctggttactagttggattcatttgtgaaagaatcattttcccctgtgtggaagacacttagtggcatatttaaattataagtccacggatcaaaaagctttttgatttcccaaaggagggacataccactatatcagataagcttgacattacagccaagatggtgctgtcccagagacaacgagatgaactaaatcgagctatagcagattatcttcgttcaaatggctatgaagaggcatattcagtttttaaaaaggaagctgaattagatgtgaatgaagaattagataaaaagtatgctggtcttttggaaaaaaaatggacatctgttattagattacaaaagaaggttatggaattagaatcaaagctaaatgaagcaaaagaagaatttacgtcaggtggacctcttggtcagaaacgagacccaaaagaatggattccccgtccgccagaaaaatatgcattgagtggtcacaggagtccagtcactcgagtcattttccatcctgtgttcagtgttatggtctctgcttcagaggatgctacaattaaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgagactaaaaaaagtggtaaacctgggccattcttgctgtctggatccagagacaagactattaagatgtgggatgtcagtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtgggtaagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaagaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaactattaaatgcctata

SEQ ID NO: 300697 - DNA, 4929 bp, Homo sapiens
tgatatgcgtctcaacaaaataaaaattaaaaaattagccaggtgtggtagcacacatctgttattagattacaaaagaaggttatggaattagaatcaaagctaaatgaagcaaaagaagaatttacgtcaggtggacctcttggtcagaaacgagacccaaaagaatggattccccgtccgccagaaaaatatgcattgagtggtcacaggagtccagtcactcgagtcattttccatcctgtgttcagtgttatggtctctgcttcagaggatgctacaattaaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgagactaaaaaaagtggtaaacctgggccattcttgctgtctggatccagagacaagactattaagatgtgggatgtcagtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtgggtaagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaagaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaactattaaatgcctata

SEQ ID NO: 300698 - DNA, 5592 bp, Homo sapiens
agggcgttggggcagctcctgtgacagacggagctggagcggcggggcggcggcggagtccggcggccgggagagcgagtgagcgagcggaggagcagcgacacgggagtctagggagcgagaaggagaaggaggggagcgctcgggcgcgagcgagagaaaccgcgagcgccgagcttggactcgagccccggaacggctgaggagcccgcccgctcacctcccctccccctccccgggcccgggcccagcgcgccatcctcccccctccttccctccctccctccttcctccctcccctctccctccccctcccccgccggtggatgggagtgaaggacggaagaggccctgcggaggcggcggtgcagcgctccggtggaatgaatcttacttgttgaatatcttctggttactagttggattcatttgtgaaagaatcattttcccctgtgtggaagacacttagtggcatatttaaattataagtccacggatcaaaaagctttttgatttcccaaaggagggacataccactatatcagataagcttgacattacagccaagatggtgctgtcccagagacaacgagatgaactaaatcgagctatagcagattatcttcgttcaaatggctatgaagaggcatattcagtttttaaaaaggaagctgaattagatgtgaatgaagaattagataaaaagtatgctggtcttttggaaaaaaaatggacatctgttattagattacaaaagaaggttatggaattagaatcaaagctaaatgaagcaaaagaagaatttacgtcaggtggacctcttggtcagaaacgagacccaaaagaatggattccccgtccgccagaaaaatatgcattgagtggtcacaggagtccagtcactcgagtcattttccatcctgtgttcagtgttatggtctctgcttcagaggatgctacaattaaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgagactaaaaaaagtggtaaacctgggccattcttgctgtctggatccagagacaagactattaagatgtgggatgtcagtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtgggtaagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaagaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaactattaaatgcctata

SEQ ID NO: 300699 - DNA, 4523 bp, Homo sapiens
tatatagtgaatgcctgtatatccttcacttagttaccatttgttggttttccttcatgtatgtgtgtatattttgctgaaatcatttgagcgttctttgcagacatcgtaacactttacccccaagtattttagcatgaaccacctaagaacaaggatagtatataaataaccaaaataaaattattcacactcaagaaatttaccattgatagactacatattgagatttgttcttgttatttccataatgccctgcgggacttctttttaaccctcatccaggacccagtcagggatcgtacgttatattcactcctcatgtcttatgagttttcagtttcctttaatctagaatcccctagacttttattttcttctggtcttttgatgtttttggtatgtatagttttatcgtattatgaaatagatgctatttaaacattttgccttttactgagtcaaataacttttttgtttttaaggtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtgggtaagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaagaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaactattaaatgcctata

SEQ ID NO: 300700 - DNA, 5204 bp, Homo sapiens
agggcgttggggcagctcctgtgacagacggagctggagcggcggggcggcggcggagtccggcggccgggagagcgagtgagcgagcggaggagcagcgacacgggagtctagggagcgagaaggagaaggaggggagcgctcgggcgcgagcgagagaaaccgcgagcgccgagcttggactcgagccccggaacggctgaggagcccgcccgctcacctcccctccccctccccgggcccgggcccagcgcgccatcctcccccctccttccctccctccctccttcctccctcccctctccctccccctcccccgccggtggatgggagtgaaggacggaagaggccctgcggaggcggcggtgcagcgctccggtggaatgaatcttacttgttgaatatcttctggttactagttggattcatttgtgaaagaatcattttcccctgtgtggaagacacttagtggcatatttaaattataagtccacggatcaaaaagctttttgatttcccaaaggagggacataccactatatcagataagcttgacattacagccaagatggtgctgtcccagagacaacgagatgaactaaatcgagctatagcagattatcttcgttcaaatggctatgaagaggcatattcagtttttaaaaaggaagctgaattagatgtgaatgaagaattagataaaaagtatgctggtcttttggaaaaaaaatggacatctgttattagattacaaaagaaggttatggaattagaatcaaagctaaatgaagcaaaagaagaatttacgtcaggtggacctcttggtcagaaacgagacccaaaagaatggattccccgtccgccagaaaaatatgcattgagtggtcacaggagtccagtcactcgagtcattttccatcctgtgttcagtgttatggtctctgcttcagaggatgctacaattaaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgagactaaaaaaagtggtaaacctgggccattcttgctgtctggatccagagacaagactattaagatgtgggatgtcagtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtgggtaagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaagaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaactttaaatatgcccacagaaccctctaaattcccttgtgaatttaactgttagtccaaagag

SEQ ID NO: 300701 - DNA, 4126 bp, Homo sapiens
cgggcagggtcttgctctgtcacccaggctggagtgcagtggtgcagtcatggctcgctgcagcctcgacttcccagctcaaacagttctgcatcagtctcccgagtagctgggactacaggcacacactaccatgcccggctaattttttttttaattttgtattttgtagagagggggtctcactatgtttgttgtccaggcttacgtgtgagttttaaataaaccatttctttttctttcagatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtgggtaagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaagaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaactattaaatgcctata

SEQ ID NO: 300702 - DNA, 3950 bp, Homo sapiens
  misc_feature (19)..(19): n is a, c, g, or t
cggccgcaccgaggccacnacatccccgtaccacctcccccatatcctcccctttctcaccctttcaccatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtgggtaagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaagaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaactattaaatgcctata

SEQ ID NO: 300703 - DNA, 4926 bp, Homo sapiens
agggcgttggggcagctcctgtgacagacggagctggagcggcggggcggcggcggagtccggcggccgggagagcgagtgagcgagcggaggagcagcgacacgggagtctagggagcgagaaggagaaggaggggagcgctcgggcgcgagcgagagaaaccgcgagcgccgagcttggactcgagccccggaacggctgaggagcccgcccgctcacctcccctccccctccccgggcccgggcccagcgcgccatcctcccccctccttccctccctccctccttcctccctcccctctccctccccctcccccgccggtggatgggagtgaaggacggaagaggccctgcggaggcggcggtgcagcgctccggtggaatgaatcttacttgttgaatatcttctggttactagttggattcatttgtgaaagaatcattttcccctgtgtggaagacacttagtggcatatttaaattataagtccacggatcaaaaagctttttgatttcccaaaggagggacataccactatatcagataagcttgacattacagccaagatggtgctgtcccagagacaacgagatgaactaaatcgagctatagcagattatcttcgttcaaatggctatgaagaggcatattcagtttttaaaaaggaagctgaattagatgtgaatgaagaattagataaaaagtatgctggtcttttggaaaaaaaatggacatctgttattagattacaaaagaaggttatggaattagaatcaaagctaaatgaagcaaaagaagaatttacgtcaggtggacctcttggtcagaaacgagacccaaaagaatggattccccgtccgccagaaaaatatgcattgagtggtcacaggagtccagtcactcgagtcattttccatcctgtgttcagtgttatggtctctgcttcagaggatgctacaattaaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgagactaaaaaaagtggtaaacctgggccattcttgctgtctggatccagagacaagactattaagatgtgggatgtcagtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtgggtaagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaactattaaatgcctata

SEQ ID NO: 300704 - DNA, 3181 bp, Homo sapiens
gttgaaaagtgctaaaacggacagtagaataaatgttgcgtggaatgccatgctttaaacaaaccctttttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtgggtaagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaagaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaactattaaatgcctata

SEQ ID NO: 300705 - DNA, 4589 bp, Homo sapiens
agggcgttggggcagctcctgtgacagacggagctggagcggcggggcggcggcggagtccggcggccgggagagcgagtgagcgagcggaggagcagcgacacgggagtctagggagcgagaaggagaaggaggggagcgctcgggcgcgagcgagagaaaccgcgagcgccgagcttggactcgagccccggaacggctgaggagcccgcccgctcacctcccctccccctccccgggcccgggcccagcgcgccatcctcccccctccttccctccctccctccttcctccctcccctctccctccccctcccccgccggtggatgggagtgaaggacggaagaggccctgcggaggcggcggtgcagcgctccggtggaatgaatcttacttgttgaatatcttctggttactagttggattcatttgtgaaagaatcattttcccctgtgtggaagacacttagtggcatatttaaattataagtccacggatcaaaaagctttttgatttcccaaaggagggacataccactatatcagataagcttgacattacagccaagatggtgctgtcccagagacaacgagatgaactaaatcgagctatagcagattatcttcgttcaaatggctatgaagaggcatattcagtttttaaaaaggaagctgaattagatgtgaatgaagaattagataaaaagtatgctggtcttttggaaaaaaaatggacatctgttattagattacaaaagaaggttatggaattagaatcaaagctaaatgaagcaaaagaagaatttacgtcaggtggacctcttggtcagaaacgagacccaaaagaatggattccccgtccgccagaaaaatatgcattgagtggtcacaggagtccagtcactcgagtcattttccatcctgtgttcagtgttatggtctctgcttcagaggatgctacaattaaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgagactaaaaaaagtggtaaacctgggccattcttgctgtctggatccagagacaagactattaagatgtgggatgtcagtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtgggtaagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccaccccgtcgggtggagcggtaccgagctcgatccgta

SEQ ID NO: 300706 - DNA, 5156 bp, Homo sapiens
agggcgttggggcagctcctgtgacagacggagctggagcggcggggcggcggcggagtccggcggccgggagagcgagtgagcgagcggaggagcagcgacacgggagtctagggagcgagaaggagaaggaggggagcgctcgggcgcgagcgagagaaaccgcgagcgccgagcttggactcgagccccggaacggctgaggagcccgcccgctcacctcccctccccctccccgggcccgggcccagcgcgccatcctcccccctccttccctccctccctccttcctccctcccctctccctccccctcccccgccggtggatgggagtgaaggacggaagaggccctgcggaggcggcggtgcagcgctccggtggaatgaatcttacttgttgaatatcttctggttactagttggattcatttgtgaaagaatcattttcccctgtgtggaagacacttagtggcatatttaaattataagtccacggatcaaaaagctttttgatttcccaaaggagggacataccactatatcagataagcttgacattacagccaagatggtgctgtcccagagacaacgagatgaactaaatcgagctatagcagattatcttcgttcaaatggctatgaagaggcatattcagtttttaaaaaggaagctgaattagatgtgaatgaagaattagataaaaagtatgctggtcttttggaaaaaaaatggacatctgttattagattacaaaagaaggttatggaattagaatcaaagctaaatgaagcaaaagaagaatttacgtcaggtggacctcttggtcagaaacgagacccaaaagaatggattccccgtccgccagaaaaatatgcattgagtggtcacaggagtccagtcactcgagtcattttccatcctgtgttcagtgttatggtctctgcttcagaggatgctacaattaaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgagactaaaaaaagtggtaaacctgggccattcttgctgtctggatccagagacaagactattaagatgtgggatgtcagtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtgggtaagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaataaaaaaaaaaaaaaaaaaaaaaaaaaaaaaaaaaaaaaaaaaaaaaaaaaaaaaaaaaaaagaacaaaaaaaaaaaaaaggaaaacagaagagatacacgaacgacacaagcaaacaccacactacaaatcacggacggcgggcccacaccacaaaaactaaacactaggaggcggcgcgagcggtcgtaccaacacacaacctcgaccgcggggggcagcacgcaggccgacgccccccgtccgcgtcattatataagcgcgagccagcgcccgcggccttataacacgacaagcgcgaggagaacacgccctatggaccaattcgggacacacaccacttcgtcgggggcatcgtgaacaaaccacacccgctggttggatgttacggaacgcagcaccaaaaacatcaatatggtcatgtaggaataaacaccactatgtgcgtggcgcagaacagccctcgggaggtgtcgaataaactaagcgccaagctacatatacataccctgacgctaagtcacacgagacgacacaacgagacaactcaacacagtgcgaacccactctgcaggtagccatcgcaagcacagtacgcacgggccgccgcggagaagagccgagaccagactcacgaacggacgagaacaggcggcagacgt

SEQ ID NO: 300707 - DNA, 1808 bp, Homo sapiens
cctatttcgagaaatataaatacaagacatttatacatgtagcaaacaaatgttaacgatgcaccatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaagaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaactattaaatgcctata

SEQ ID NO: 300708 - DNA, 3181 bp, Homo sapiens
agggcgttggggcagctcctgtgacagacggagctggagcggcggggcggcggcggagtccggcggccgggagagcgagtgagcgagcggaggagcagcgacacgggagtctagggagcgagaaggagaaggaggggagcgctcgggcgcgagcgagagaaaccgcgagcgccgagcttggactcgagccccggaacggctgaggagcccgcccgctcacctcccctccccctccccgggcccgggcccagcgcgccatcctcccccctccttccctccctccctccttcctccctcccctctccctccccctcccccgccggtggatgggagtgaaggacggaagaggccctgcggaggcggcggtgcagcgctccggtggaatgaatcttacttgttgaatatcttctggttactagttggattcatttgtgaaagaatcattttcccctgtgtggaagacacttagtggcatatttaaattataagtccacggatcaaaaagctttttgatttcccaaaggagggacataccactatatcagataagcttgacattacagccaagatggtgctgtcccagagacaacgagatgaactaaatcgagctatagcagattatcttcgttcaaatggctatgaagaggcatattcagtttttaaaaaggaagctgaattagatgtgaatgaagaattagataaaaagtatgctggtcttttggaaaaaaaatggacatctgttattagattacaaaagaaggttatggaattagaatcaaagctaaatgaagcaaaagaagaatttacgtcaggtggacctcttggtcagaaacgagacccaaaagaatggattccccgtccgccagaaaaatatgcattgagtggtcacaggagtccagtcactcgagtcattttccatcctgtgttcagtgttatggtctctgcttcagaggatgctacaattaaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgagactaaaaaaagtggtaaacctgggccattcttgctgtctggatccagagacaagactattaagatgtgggatgtcagtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtgggtaagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagcctcgtatacggtagggctcgatgta

SEQ ID NO: 300709 - DNA, 2769 bp, Homo sapiens
agggcgttggggcagctcctgtgacagacggagctggagcggcggggcggcggcggagtccggcggccgggagagcgagtgagcgagcggaggagcagcgacacgggagtctagggagcgagaaggagaaggaggggagcgctcgggcgcgagcgagagaaaccgcgagcgccgagcttggactcgagccccggaacggctgaggagcccgcccgctcacctcccctccccctccccgggcccgggcccagcgcgccatcctcccccctccttccctccctccctccttcctccctcccctctccctccccctcccccgccggtggatgggagtgaaggacggaagaggccctgcggaggcggcggtgcagcgctccggtggaatgaatcttacttgttgaatatcttctggttactagttggattcatttgtgaaagaatcattttcccctgtgtggaagacacttagtggcatatttaaattataagtccacggatcaaaaagctttttgatttcccaaaggagggacataccactatatcagataagcttgacattacagccaagatggtgctgtcccagagacaacgagatgaactaaatcgagctatagcagattatcttcgttcaaatggctatgaagaggcatattcagtttttaaaaaggaagctgaattagatgtgaatgaagaattagataaaaagtatgctggtcttttggaaaaaaaatggacatctgttattagattacaaaagaaggttatggaattagaatcaaagctaaatgaagcaaaagaagaatttacgtcaggtggacctcttggtcagaaacgagacccaaaagaatggattccccgtccgccagaaaaatatgcattgagtggtcacaggagtccagtcactcgagtcattttccatcctgtgttcagtgttatggtctctgcttcagaggatgctacaattaaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgagactaaaaaaagtggtaaacctgggccattcttgctgtctggatccagagacaagactattaagatgtgggatgtcagtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacagttcctcagacagttttgaaaatttggaagaagaatccaatgaaagtggtagcccttttgaccctgtttttgaagttgaacctaaaatctctaacgataacccagaggaacatgtactgttaattcctgtccagagagctgtctcatctccctcttcagacagggagaacaggcatcttcctccttaccctggaatttccaacagttcccaccaaaaagtgctgaatgaaccagaataggggccgagaaggaaaattaccacctgtttcacctgctcctccttcagagcaagaaattctagcattggttgggctaggggttggggggtagggagaaaaagaaggaagagagttaccaaaagtaaacataagacaaaaccctagtggtatagatggaagactatgttccagtaaaccagagagctggttcctccctcgactctgcacagccactgaaagtttaaagattgcaaaagtggtgtggggcaaggaggtagagtcaatcaatgaaactgtgaaaaggaattc

SEQ ID NO: 300710 - DNA, 407 bp, Homo sapiens
accccatggtaaaatcccatggtcaattgatgtttcattgctcttggtggtatattacttcataatatattgctgttatgtgttttaggccatgaccacaatgtttcttcagtagccatcatgcccaatggagatcatatagtgtctgcctcaagggataaaactataaaaatgtgggaagtgcaaactgggtaagtaagtttagttgaaaaggcatcagcggccaggtgcagtggctcacacctgtcatcccagcgctttgggaggccaaggtgggcagatcacctggtcaggaattgaagaccagcctggccaacatgatgaaaccccatctctactaaaaatacaaaaattagccgggtgtggtggcgcacacctgtattcccagctacttgggaggctgagac

SEQ ID NO: 300711 - DNA, 481 bp, Homo sapiens
ttgacaaatgctttggagattactgaaattttttcaagtatcctacatacatagttgcaaaataaaggcagttttttaaaatgtcacatgctatttttattgaaatctatctgtacgtaactacatgttctttttcaaggttatggaattagaatcaaagctaaatgaagcaaaagaagaatttacgtcaggtggacctcttggtcagaaacgagacccaaaagaatggattccccgtccgccagaaaaatatgcattgagtggtcacaggagtccagtcactcgagtcattttccatcctgtgttcagtgttatggtctctgcttcagaggatgctacaattaaggtaattttttgttaaaagcagacttaacgggaggctgaagcaggagaatggcatgaacccgggaggcggagtttgcagtgagccgagattgcaccactgcactccagcctgggcgacagagccacactctgtctc

SEQ ID NO: 300712 - DNA, 609 bp, Homo sapiens
aagaaatttaccattgatagactacatattgagatttgttcttgttatttccataatgccctgcgggacttctttttaaccctcatccaggacccagtcagggatcgtacgttatattcactcctcatgtcttatgagttttcagtttcctttaatctagaatcccctagacttttattttcttctggtcttttgatgtttttggtatgtatagttttatcgtattatgaaatagatgctatttaaacattttgccttttactgagtcaaataacttttttgtttttaaggtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttgggtatgtacgcctcgcgaggtctctgaacattagattttggagtgccagacaaactgtgttttacataatcgtgtggactttgccaggtaagaaatgactgtgctttcagggcagaatagagaagacatgaaaatcttgtggattcctaccatttgttttaaa

SEQ ID NO: 300713 - DNA, 5822 bp, Homo sapiens
ctcacagacaacagccaagcacagaggaaatattagctggcagagataacgaagagaaaacactcggtgacagatgcaccatctgtcagtttctgaggagcagttttcaagaaagctgaaaatgaattgaagaagagaggggttttgtttgaaaggtacagcacagcctaaggacaattttaaacaaaaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgagtttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaaaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatgtctacctaagaaggaagcagtaaatccataatttaccttttgggcaatgctttgtgagcaaaacaaagtcacttctgccataacatcttgaatttaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaatttatatatattaaatatttcctattttctataaaatagat

SEQ ID NO: 300714 - DNA, 3789 bp, Homo sapiens
ggtgcccctttctaaaccctgcttggccatcgagagcgtgggatccaaagttcaattgcaagggttgggactcagctctgcctcccatgagctgcgaggcctcagcaattactgacttctttgtgcctttcctgctgttctggttgtttttgttgatgatgactctgggtgcgtgttcacacgaggaatgtggagcttacacagtgcttcccagctggctctttctatgtctgctcctccaatgacctggcatccacttttcctcagatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaaaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatgtctacctaagaaggaagcagtaaatccataatttaccttttgggcaatgctttgtgagcaaaacaaagtcacttctgccataacatcttgaatttaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaatttatatatattaaatatttcctattttctataaaatagat

SEQ ID NO: 300715 - DNA, 841 bp, Homo sapiens
ctcacagacaacagccaagcacagaggaaatattagctggcagagataacgaagagaaaacactcggtgacagatgcaccatctgtcagtttctgaggagcagttttcaagaaagctgaaaatgaattgaagaagagaggggttttgtttgaaaggtacagcacagcctaaggacaattttaaacaaaaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagaagagaaaagggaccctttaaggattcgagatgaccttccctgcctctgtaagagtcaggtggaggagtattctcgagcttagctgcacgcctcactggaagactaacaacccagccaagagcatttcaggagacaggacaccagcacttctgccgcctgcagctcgggctctccactcccgcggcattcccagcggcccattcctgcttccaaacaggcaggcccggccacgtagctccagttaacgtctaaatttctatgtgactatggatgcgttgccttttgcagctgtggattcgtgtgggttcctgtttccagtgtaaagatatggccaaattccgtcttttgaaaaaagcccttctttatggaatgtctggttggcatctgtctctgaggaatatataatttcagtgaagaatgttctcatttttaga

SEQ ID NO: 300716 - DNA, 439 bp, Homo sapiens
ggtaatctggcactggactgatcctcctcacctttcagagatattcagagacaaactggagtctgggtgagcctctagcccttggcctgacacctgcaagggtctcatgtttcctcagcaatacactcaattcactgtgtatattgtttttataagaggcatggttcttgccatctgtactaaagtccacaatttatttattgtcttcatggcaattgtgtttaatcctgtagattttggtgggctgacacaaggaagaatgtgaaaagtccacaaataggtgatgatggtgatgaaggctttttcatgcctggttagccatacacctttcttatacatgaaatgccacttccaaagcactgggagaaatgacaacaccgctaccctcccacaatacagtttctaactgttttgcagaagagaaaagggaccctttaag

SEQ ID NO: 300717 - DNA, 477 bp, Homo sapiens
caggttgttggcaggaaaatataaacacaaaccttagctctgtgttcaggttcttcttcctccctcagtcatgactctgatgtgcggattgttttgctacaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaagtaagtgctgactcccttaatggcaggctcagatcttgggagtctcagcttgtacagcacatccagcagggatgtcaccctgatttcttatttcactgtatttgtttcctcattgccattagtgtgctttcataggtggatatgtatgcctcccctctgtctttccccctttcctgaaattctgacatttctcctgca

SEQ ID NO: 300718 - DNA, 8091 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (57)..(57): n is a, c, g, or t
cngcngnanccggcgaaagaggcaaagtcccgcacgccggaggacatgcgcctcggntagcggccccgggccccaccaccgtgcggctttctccagattattcctctctcgctgtctctgactgtctctctctgtctctgtctctgtctctctctctctcacacacacacacacacacacaaacacacatacgcacgcacgatctcacttcgatctatacactggaggattaaaacaaacaaacaaaaaaaacatttccttcgctccccctccctctccactctgagaagcagaggagccgcacggcgaggggccgcagaccgtctggaaatgcgaatcctaaagcgtttcctcgcttgcattcagctcctctgtgtttgccgcctggattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgacagagatagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaa

SEQ ID NO: 300719 - DNA, 8034 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (57)..(57): n is a, c, g, or t
cngcngnanccggcgaaagaggcaaagtcccgcacgccggaggacatgcgcctcggntagcggccccgggccccaccaccgtgcggctttctccagattattcctctctcgctgtctctgactgtctctctctgtctctgtctctgtctctctctctctcacacacacacacacacacacaaacacacatacgcacgcacgatctcacttcgatctatacactggaggattaaaacaaacaaacaaaaaaaacatttccttcgctccccctccctctccactctgagaagcagaggagccgcacggcgaggggccgcagaccgtctggaaatgcgaatcctaaagcgtttcctcgcttgcattcagctcctctgtgtttgccgcctggattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgacagagatagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaa

SEQ ID NO: 300720 - DNA, 8070 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (57)..(57): n is a, c, g, or t
cngcngnanccggcgaaagaggcaaagtcccgcacgccggaggacatgcgcctcggntagcggccccgggccccaccaccgtgcggctttctccagattattcctctctcgctgtctctgactgtctctctctgtctctgtctctgtctctctctctctcacacacacacacacacacacaaacacacatacgcacgcacgatctcacttcgatctatacactggaggattaaaacaaacaaacaaaaaaaacatttccttcgctccccctccctctccactctgagaagcagaggagccgcacggcgaggggccgcagaccgtctggaaatgcgaatcctaaagcgtttcctcgcttgcattcagctcctctgtgtttgccgcctggattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgacagagatagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaa

SEQ ID NO: 300721 - DNA, 7232 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (57)..(57): n is a, c, g, or t
cngcngnanccggcgaaagaggcaaagtcccgcacgccggaggacatgcgcctcggntagcggccccgggccccaccaccgtgcggctttctccagattattcctctctcgctgtctctgactgtctctctctgtctctgtctctgtctctctctctctcacacacacacacacacacacaaacacacatacgcacgcacgatctcacttcgatctatacactggaggattaaaacaaacaaacaaaaaaaacatttccttcgctccccctccctctccactctgagaagcagaggagccgcacggcgaggggccgcagaccgtctggaaatgcgaatcctaaagcgtttcctcgcttgcattcagctcctctgtgtttgccgcctggattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgacagagatagtgatggcttatccattcataagtgtatgtcatgctcatcctatagagaatcacaggaaaaggtaatgaatgattcagacacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaa

SEQ ID NO: 300722 - DNA, 8208 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (57)..(57): n is a, c, g, or t
cngcngnanccggcgaaagaggcaaagtcccgcacgccggaggacatgcgcctcggntagcggccccgggccccaccaccgtgcggctttctccagattattcctctctcgctgtctctgactgtctctctctgtctctgtctctgtctctctctctctcacacacacacacacacacacaaacacacatacgcacgcacgatctcacttcgatctatacactggaggattaaaacaaacaaacaaaaaaaacatttccttcgctccccctccctctccactctgagaagcagaggagccgcacggcgaggggccgcagaccgtctggaaatgcgaatcctaaagcgtttcctcgcttgcattcagctcctctgtgtttgccgcctggattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgacagagatagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagggtctcactctgtcacccaggctggagtgcagaggcacaatctcggctcactgcaaccttcctctccctggcttaactgatcctcctacctcagcctcccgagtggctaggactatactcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaa

SEQ ID NO: 300723 - DNA, 7994 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (57)..(57): n is a, c, g, or t
cngcngnanccggcgaaagaggcaaagtcccgcacgccggaggacatgcgcctcggntagcggccccgggccccaccaccgtgcggctttctccagattattcctctctcgctgtctctgactgtctctctctgtctctgtctctgtctctctctctctcacacacacacacacacacacaaacacacatacgcacgcacgatctcacttcgatctatacactggaggattaaaacaaacaaacaaaaaaaacatttccttcgctccccctccctctccactctgagaagcagaggagccgcacggcgaggggccgcagaccgtctggaaatgcgaatcctaaagcgtttcctcgcttgcattcagctcctctgtgtttgccgcctggattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgacagagatagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgagtcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaa

SEQ ID NO: 300724 - DNA, 5236 bp, Homo sapiens
  misc_feature (79)..(79): n is a, c, g, or t
  misc_feature (106)..(106): n is a, c, g, or t
  misc_feature (181)..(181): n is a, c, g, or t
  misc_feature (219)..(219): n is a, c, g, or t
  misc_feature (255)..(255): n is a, c, g, or t
  misc_feature (303)..(303): n is a, c, g, or t
  misc_feature (310)..(310): n is a, c, g, or t
gaatactcttatgaaacttacttaagttgtctctttccccaagctctgaactttacaaacccattttatgtaactccanagaacaggctgacttcagtgtgaaaanttctctgatctaaaatctgattttttcaccctgcatttgcattccccttccacctcctttctaatcttgtttgtncctccctaggaaaggaagcctttgtctgcctgaacttngcaattcttaaagaccttgtagttggtacttctgtngcaatatttctttggaagtcaaaatttttatgtaaattcaaccttgtnttatttncaaagtctataaactgcctcaaaacaagaacaacttcatcttcagtaagaccctcccaatcccctccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgacagagatagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaa

SEQ ID NO: 300725 - DNA, 4474 bp, Homo sapiens
tctggaacttgactaatctcatgatcaaaaaccttagtggtggtatgagcaagggattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgacagagatagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaa

SEQ ID NO: 300726 - DNA, 4783 bp, Homo sapiens
tacgctgcgggaccggccccgggaggggggggcggagcccgcgaagggggcccaccgacacagagggcgacagcccgtaacaggcacaccgccagagcgaagcacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgacagagatagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaa

SEQ ID NO: 300727 - DNA, 5514 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (57)..(57): n is a, c, g, or t
cngcngnanccggcgaaagaggcaaagtcccgcacgccggaggacatgcgcctcggntagcggccccgggccccaccaccgtgcggctttctccagattattcctctctcgctgtctctgactgtctctctctgtctctgtctctgtctctctctctctcacacacacacacacacacacaaacacacatacgcacgcacgatctcacttcgatctatacactggaggattaaaacaaacaaacaaaaaaaacatttccttcgctccccctccctctccactctgagaagcagaggagccgcacggcgaggggccgcagaccgtctggaaatgcgaatcctaaagcgtttcctcgcttgcattcagctcctctgtgtttgccgcctggattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatgaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaa

SEQ ID NO: 300728 - DNA, 3132 bp, Homo sapiens
gcaggacattttggatattctggagcacagtggaagaatatgtagggcattgaggtttcctatattaacaaagtatcactttgaacccagctacaacttcaaattctgtctgtgcttttagcatgcctgatatctacttgctcttctgcatctgctacaggtaaaactgagataaattttataatttaacatcttgtgacttgttaaaatggatgtagatccagcaatccctcttctgggtatatacctgcttttgttttaattctggagatttctatcaaaattttcaagcagctcagaaattgtcttattttccatagcaactagtagtataaattgtgttcttttatttccaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaa

SEQ ID NO: 300729 - DNA, 3111 bp, Homo sapiens
gcaggacattttggatattctggagcacagtggaagaatatgtagggcattgaggtttcctatattaacaaagtatcactttgaacccagctacaacttcaaattctgtctgtgcttttagcatgcctgatatctacttgctcttctgcatctgctacaggtaaaactgagataaattttataatttaacatcttgtgacttgttaaaatggatgtagatccagcaatccctcttctgggtatatacctgcttttgttttaattctggagatttctatcaaaattttcaagcagctcagaaattgtcttattttccatagcaactagtagtataaattgtgttcttttatttccaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaa

SEQ ID NO: 300730 - DNA, 2737 bp, Homo sapiens
tatttcactgcattttcttttagccaagaagtagttgtaacttttaaaaaatttcatttgatagattattttgtttgttttgtcttcgttattatattttaaggcacgttgtttgaaagaatgtgtgttaaaatgatttacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaa

SEQ ID NO: 300731 - DNA, 917 bp, Homo sapiens
tcagctatatttccatcaggcaatgctgcaccattactgtccagagaggtggagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaa

SEQ ID NO: 300732 - DNA, 312 bp, Homo sapiens
tacgaaaaattatgctgaccttaaaaacttaggcattgtacagttaaagatgacatataaatcagttagtaggaaacatttgtcatttaattcttcagggctacaacagaccaaaagcttatattgctgcccaaggcccactgaaatccacagctgaagatttctggagaatgatatgggaacataatgtggaagttattgtcatgataacaaacctcgtggagaaaggaagggtatgtagataatctgttatgtcacccccaaaaaagtaattagaggtactttaaattagttttaatagagtcagcatta

SEQ ID NO: 300733 - DNA, 516 bp, Homo sapiens
ctgaacttatgttataaatatataaaatacagtttgttatatatgtatttatacattatattatatgtgtattatacatgtctttatatgatactctcaggttttttttattattgccaactcctttcatagtatacaaataataaaccataagcaaatactaaacttctgtaaagtattccactattgatatcatgaacacttggcaatatttcagattaaatcatagttctttgtgcaaaaagcgaagagagacaattcattaaaagtttcagtgttttcactgcaaagttgtcaaggctatatgctttgtgagttctaaatgtgagtggtgcatctcaatggagtctttgttccttttcttttttttttttacaaggcatggaggagtgacggcaggaactttctgtgctctgacaacccttatgcaccaactagaaaaagaaaattccgtggatgtttaccaggtagccaagatgatcaatctgatgaggccaggagtctttgctgacattg

SEQ ID NO: 300734 - DNA, 516 bp, Homo sapiens
caaaaagcgaagagagacaattcattaaaagtttcagtgttttcactgcaaagttgtcaaggctatatgctttgtgagttctaaatgtgagtggtgcatctcaatggagtctttgttccttttcttttttttttttacaaggcatggaggagtgacggcaggaactttctgtgctctgacaacccttatgcaccaactagaaaaagaaaattccgtggatgtttaccaggtagccaagatgatcaatctgatgaggccaggagtctttgctgacattgtaagtaacaaggcagtgaacgaaatttttcactgatagagtacaactaacttcctagaggctgctgaaatcttatgtatcaagaaagatcttattaactgataacattagtatgtagttttcaagctgaattacaagtccacaatccatagaacaacaacatttaaaatttatacttcagaaaatttatggataaaaacttttaaatctcatgtttgcctttgtgcacaatagtaaac

SEQ ID NO: 300735 - DNA, 165 bp, Homo sapiens
tacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaa

SEQ ID NO: 300736 - DNA, 867 bp, Homo sapiens
ctgagccggtaccgcacgagttcggagttggctcttgttgcccaggcgaatgcaatggcgtgatctcggctcactgcaacctctgcctcccaggttcaagcaattctcctgcctcagcctcccgagtagctgggattacaggcatgagccaccgcgcccggctaattttctatttttagtagagacttggggggtctccctatgttgcttaggctggtctcaacctcctgggctcaagtgatcgtcctgccttggcctcccaaagtgctgggattacaggcttgaaccaccctgccccagacccaggggaaggagaaggggaagagtcagagctgacacagcagttttgcagcttggacacagcaagtgctttttaaggcctgttttaagcttcttcagttcccatttggagaatccggcccaaggtttcacatcccatttctgtgatgaaccctaaaccccttgtccagcattgcttgggcatcacgtgttcctggctgctcagctccactggccagttcctctcagtgtgcgcctcacattgggatcactcaagctcgggccataatctcttaaactctggagcaaagacctcagtgagccccccggttgccatgcaagttgcatagcaatagcgtcaatgtgcccatataaagggcctaataattccaactgcctcccagaattgaggcttttttcttttttgagacagagtcttactctgttgcccaagctggagcacagtggcgccatctcagctcaccgcaacttccgtgaggcagacatgttttttgtttgagatgggagttccactctttttgcccaggctggagtgcaatgacgccatctcagctcactgcaacctcc

SEQ ID NO: 300737 - DNA, 5600 bp, Homo sapiens
cttaattctagaagggagcgcccgtagccagcgcccccgtaaagaaataaggaggcgcccggcttcccgcccaggcccagggccccagtgcagcctggacacagtattcaaagttttggcgtctgagcattgttatgcgttattttcaagctttgctaacggtttttaaacctttgagatgtttccattaattggaaaaacaatcatctttgataactttcctgatccttctgatacatgggaaatcactgagacaattggcaaaggaacttatgggaaagtttttaaagtattgaataagaaaaatggccaaaaagcagcagtcaaaattcttgatccaattcacgatattgacgaagagattgaagcagaatataacatcttaaaagcactttctgaccaccctaatgtggtcagattctatgggatatactttaagaaggataaagtaaatggagacaagctgtggttggttcttgagctctgcagtggaggatcagtgactgaccttgtgaaaggatttctgaagaggggtgaaagaatgagtgagcctctaattgcctatattttacatgaagcactaatgggacttcaacatttgcataacaacaaaactatccacagagatgtgaaaggcaataacattctattgaccacggaaggtggagtgaaactagtagattttggtgtgtctgcacagctcaccagtacccggcaccgtcggaacacatccgtaggaacaccgttttggatggctcctgaggtgattgcatgtgaacagcaattggataccacttatgacgccagatgtgacacttggtccctgggtatcacggccattgagctgggtgatggagatcctccactagctgaccttcatcccatgagagcactcttcaaaataccaaggaatccacccccaaaactaaggcagcctgagctatggtcagcagaattcaatgacttcataagcaagtgcttgactaaagattatgaaaagcgtccaacagtgtcagaacttttacagcataaattcattactcaaattgagggcaaagatgtgatgctacaaaaacaactaacggaattcattggcatccatcaatgcatgggaggcacagaaaaggccagacgtgaacgtattcacacgaagaaagggaacttcaaccgacctctaatatccaatctgaaggatgtagatgatttagcaaccctagaaattttggatgagaatacagtctcagagcaacttgagaagtgttattccagagatcagatctacgtctatgtgggagacatactcattgctcttaacccttttcagagtctgggtctttactccacaaagcattccaaactatatattggatcaaagagaactgccagtcctcctcacatttttgcaatggctgacttaggatatcaatctataataacatataattcagatcagtgcattgttatttctggagaaagtggtgctggaaagactgaaaatgctcatcttttagttcagcagctgacagtgcttggaaaggctaataacagaaccttgcaagagaagattttacaagtgaacaatttggtagaagcctttggcaatgcctgcactattataaatgacaattctagcagatttggaaaatacttagaaatgaaattcacctcttctggagcggtagtgggagcacagatttctgaatatctcctggaaaaatcccgagttatccaccaagctattggagaaaaaaattttcatattttttactacatttatgctggtttggctgaaaagaagaaactagcccattacaaactgcctgaaaataagcctcccaggtacctacaaaatgaccacctcagaacagtacaagacatcatgaataatagtttctataaatcccagtatgaattaattgagcaatgtttcaaagtcataggttttacaatggagcaacttggtagtatatacagcatactcgctgcaatcttgaatgttggcaacattgaattttcttctgtggcaactgaacaccagattgacaagagccacatttctaatcatacagccctggagaactgtgtttctttgctttgcattcgggcagatgagctacaagaagctctcacctcccactgtgtggtcactagaggagaaacaattatacgacccaatactgtagaaaaagctaccgatgtcagggatgccatggctaaaactttatatggacgtctctttagttggatagtcaattgcattaacagtttgttgaagcatgactcatcaccaagtgggaatggtgatgagctgagcattggcattcttgatatatttggttttgaaaatttcaaaaaaaattccttcgagcagctgtgcattaacattgcaaatgaacaaattcagtattattataatcaacatgtgtttgcatgggaacagaatgaatacctaaatgaagatgtggatgctagagttattgaatatgaggataactggcccctcttagatatgtttctgcaaaagccaatgggtttactttccctacttgatgaagaaagtagatttcccaaggccactgaccagactcttgtagaaaaatttgaaggtaacctgaaatcacaatacttctggagacccaaaagaatggaacttagttttggaattcaccattatgcaggaaaggtcctctataatgcaagtggattcttagccaaaaacaagacactagttcctactgacattgtgctacttttgaggtcatccgacaacagtgtaattaggcaactagtcaaccaccctctgaccaaaacaggtaatctgccacattctaaactaaaaatgttaaactatcaaatgaggacttcagaaaaattaatcaacctggcaaagggcgacactggagaagccacacgtcatgccagagagacaaccaacatgaaaacacaaacggttgcatcatattttagatattccctgatggatttgttgtctaaaatggtggtgggccaacctcattttgtccgttgcatcaaaccaaatagtgagcgtcaggcaagaaaatatgacaaagagaaagttctgctacagcttcggtacacaggaattctggaaacagcaagaattcgaagactaggattctcccatcggatactttttgctaactttataaagcggtactaccttctctgctacaagtcgagcgaggagccccgcatgagccctgacacctgtgccaccattttggaaaaagctggtctcgataactgggctcttggaaaaacaaaagtgttccttaagtattatcacgtggagcagttaaatctaatgcgaaaggaagctattgacaagcttattttgattcaagcttgtgtcagagcattcttgtgttcaagaagataccaaaaaatacaggagaaaaggaaagaaagcgctataataatacagtcagctgcaagaggacaccttgtcgggaaacaaagaaaagaaattgttgacatgaaaaacacagcagtaacaaccattcaaacttctgatcaggaattcgactacaagaaaaactttgaaaatacaagggaatctttcgtgaagaaacaagcagaaaatgcaatctctgctaatgaaagattcatttcagctccaaataataaaggaagtgtatctgtagtgaagacttccactttcaaacctgaagaggaaaccaccaatgctgtggagagtaacaacagagtgtatcagactccaaaaaaaatgaataatgtgtatgaggaagaggttaagcaagaattttaccttgtagggccagaagtaagccccaaacagaagtttgtcaaagacctggaagagaacagcaatctaaggaaagtggagaaagaggaagctatgatccagagttactatcagaggtacacagaggagaggaattgtgaagagtcaaaagcagcatatctagaaaggaaggccatatcagaaaggccaagctacccagtgccttggttagctgaaaatgagacttcctttaaaaaaactttggaacctacacttagccaaaggtcaatttatcaaaatgcaaacagcatggaaaaagaaaagaagacatctgtagttacccagagtgcaccgatatgcagccaggaggaaggcagaggccgtctgaggcatgagacagtcaaagagaggcaagttgaaccagtgacacaggcccaggaggaagaagataaagcagcggtattcattcagagcaaataccggggttacaagagaaggcagcagttgaggaaggacaagatgtcttcttttaagcatcagaagattgtcacaacaccaacagaagtagcaagaaacactcataatttgtattcctatcccacaaaacatgaggaaatcaataacatcaagaagaaggataacaaagactcgaaagcaacttcagaaagagaagcatgtggtttggcaattttttcaaaacagatatcaaagttatctgaagaatatttcattctgcagaaaaaattgaatgaaatgattttgtcacagcaactgaagtcactttatctgggtgtctcgcaccataagccaattaatagacgagtttcttctcagcagtgcctctcaggtgtctgtaaaggagaggagccaaaaatattgagacccccaagacgaccccggaaacccaaaacattaaataaccctgaagactccacatactattatctacttcataagtcaatccaagaagaaaaacgaagaccaaggaaagacagtcagggaaaattattagatttggaagatttctattataaggaatttttgcccagtcgttctggaccaaaggaacatagccctagtttaagagaacgaagaccacagcaagaactccagaatcaatgtattaaggctaatgaaaggtgctgggcggcggagagccccgagaaggaggaggagagagagccagcagccaacccctacgacttcaggaggctcctgcgcaaaacctcccagcgccggcgcctcgtccagcagtcctaaccgttcaacgaggcagtcaccgccgtcggaaggcgctggagcctgcggggcagcaggggccaagcaggcactctggggctggcaccagcaggcactgaagctgcggccctgatctccgcagaggctgcctgctgcgctcggccctcaagtgcccgggccggccttcgtgctccgaaacaagagacctgggagccctcgggaaacctcccccgacgctctctctcggaactcccgcaccctcctttctcaccagcccgccagttgtggcaaccctgtccttgttcccctaatctatcactttgttctttttttttgtgactcctgtggactccactgcgcctgggatctcgccaacccctctctcatttggggtgactgaattcacagatttttttttttattggaaacggcttttcttggccaacagaacacttgctagcggttgaatcttagagaaaaaagcccgggaggggtggggagaatttcgaagatgtatttcatctcaagcttgctctttctcttcctttggttattaaggtcactaaataaaggaagtgccttggaaaacccgtgg

SEQ ID NO: 300738 - DNA, 5493 bp, Homo sapiens
cttaattctagaagggagcgcccgtagccagcgcccccgtaaagaaataaggaggcgcccggcttcccgcccaggcccagggccccagtgcagcctggacacagtattcaaagttttggcgtctgagcattgttatgcgttattttcaagctttgctaacggtttttaaacctttgagatgtttccattaattggaaaaacaatcatctttgataactttcctgatccttctgatacatgggaaatcactgagacaattggcaaaggaacttatgggaaagtttttaaagtattgaataagaaaaatggccaaaaagcagcagtcaaaattcttgatccaattcacgatattgacgaagagattgaagcagaatataacatcttaaaagcactttctgaccaccctaatgtggtcagattctatgggatatactttaagaaggataaagtaaatggagacaagctgtggttggttcttgagctctgcagtggaggatcagtgactgaccttgtgaaaggatttctgaagaggggtgaaagaatgagtgagcctctaattgcctatattttacatgaagcactaatgggacttcaacatttgcataacaacaaaactatccacagagatgtgaaaggcaataacattctattgaccacggaaggtggagtgaaactagtagattttggtgtgtctgcacagctcaccagtacccggcaccgtcggaacacatccgtaggaacaccgttttggatggctcctgaggtgattgcatgtgaacagcaattggataccacttatgacgccagatgtgacacttggtccctgggtatcacggccattgagctgggtgatggagatcctccactagctgaccttcatcccatgagagcactcttcaaaataccaaggaatccacccccaaaactaaggcagcctgagctatggtcagcagaattcaatgacttcataagcaagtgcttgactaaagattatgaaaagcgtccaacagtgtcagaacttttacagcataaattcattactcaaattgagggcaaagatgtgatgctacaaaaacaactaacggaattcattggcatccatcaatgcatgggaggcacagaaaaggccagacgtgaacgtattcacacgaagaaagggaacttcaaccgacctctaatatccaatctgaaggatgtagatgatttagcaaccctagaaattttggatgagaatacagtctcagagcaacttgagaagtgttattccagagatcagatctacgtctatgtgggagacatactcattgctcttaacccttttcagagtctgggtctttactccacaaagcattccaaactatatattggatcaaagagaactgccagtcctcctcacatttttgcaatggctgacttaggatatcaatctataataacatataattcagatcagtgcattgttatttctggagaaagtggtgctggaaagactgaaaatgctcatcttttagttcagcagctgacagtgcttggaaaggctaataacagaaccttgcaagagaagattttacaagtgaacaatttggtagaagcctttggcaatgcctgcactattataaatgacaattctagcagatttggaaaatacttagaaatgaaattcacctcttctggagcggtagtgggagcacagatttctgaatatctcctggaaaaatcccgagttatccaccaagctattggagaaaaaaattttcatattttttactacatttatgctggtttggctgaaaagaagaaactagcccattacaaactgcctgaaaataagcctcccaggtacctacaaaatgaccacctcagaacagtacaagacatcatgaataatagtttctataaatcccagtatgaattaattgagcaatgtttcaaagtcataggttttacaatggagcaacttggtagtatatacagcatactcgctgcaatcttgaatgttggcaacattgaattttcttctgtggcaactgaacaccagattgacaagagccacatttctaatcatacagccctggagaactgtgtttctttgctttgcattcgggcagatgagctacaagaagctctcacctcccactgtgtggtcactagaggagaaacaattatacgacccaatactgtagaaaaagctaccgatgtcagggatgccatggctaaaactttatatggacgtctctttagttggatagtcaattgcattaacagtttgttgaagcatgactcatcaccaagtgggaatggtgatgagctgagcattggcattcttgatatatttggttttgaaaatttcaaaaaaaattccttcgagcagctgtgcattaacattgcaaatgaacaaattcagtattattataatcaacatgtgtttgcatgggaacagaatgaatacctaaatgaagatgtggatgctagagttattgaatatgaggataactggcccctcttagatatgtttctgcaaaagccaatgggtttactttccctacttgatgaagaaagtagatttcccaaggccactgaccagactcttgtagaaaaatttgaaggtaacctgaaatcacaatacttctggagacccaaaagaatggaacttagttttggaattcaccattatgcaggaaaggtcctctataatgcaagtggattcttagccaaaaacaagacactagttcctactgacattgtgctacttttgaggtcatccgacaacagtgtaattaggcaactagtcaaccaccctctgaccaaaacaggtaatctgccacattctaaactaaaaatgttaaactatcaaatgaggacttcagaaaaattaatcaacctggcaaagggcgacactggagaagccacacgtcatgccagagagacaaccaacatgaaaacacaaacggttgcatcatattttagatattccctgatggatttgttgtctaaaatggtggtgggccaacctcattttgtccgttgcatcaaaccaaatagtgagcgtcaggcaagaaaatatgacaaagagaaagttctgctacagcttcggtacacaggaattctggaaacagcaagaattcgaagactaggattctcccatcggatactttttgctaactttataaagcggtactaccttctctgctacaagtcgagcgaggagccccgcatgagccctgacacctgtgccaccattttggaaaaagctggtctcgataactgggctcttggaaaaacaaaagtgttccttaagtattatcacgtggagcagttaaatctaatgcgaaaggaagctattgacaagcttattttgattcaagcttgtgtcagagcattcttgtgttcaagaagataccaaaaaatacaggagaaaaggaaagaaagcgctataataatacagtcagctgcaagaggacaccttgtcgggaaacaaagaaaagaaattgttgacatgaaaaacacagcagtaacaaccattcaaacttctgatcaggaattcgactacaagaaaaactttgaaaatacaagggaatctttcgtgaagaaacaagcagaaaatgcaatctctgctaatgaaagattcatttcagctccaaataataaaggaagtgtatctgtagtgaagacttccactttcaaacctgaagaggaaaccaccaatgctgtggagagtaacaacagagtgtatcagactccaaaaaaaatgaataatgtgtatgaggaagaggttaagcaagaattttaccttgtagggccagaagtaagccccaaacagaagtttgtcaaagacctggaagagaacagcaatctaaggaaagtggagaaagaggaagctatgatccagagttactatcagaggtacacagaggagaggaattgtgaagagtcaaaagcagcatatctagaaaggaaggccatatcagaaaggccaagctacccagtgccttggttagctgaaaatgagacttcctttaaaaaaactttggaacctacacttagccaaaggtcaatttatcaaaatgcaaacagcatggaaaaagaaaagaagacatctgtagttacccagagtgcaccgatatgcagccaggaggaaggcagaggccgtctgaggcatgagacagtcaaagagaggcaagttgaaccagtgacacaggcccaggaggaagaagataaagcagcggtattcattcagagcaaataccggggttacaagagaaggcagcagttgaggaaggacaagatgtcttcttttaagcatcagaagattgtcacaacaccaacagaagtagcaagaaacactcataatttgtattcctatcccacaaaacatgaggaaatcaataacatcaagaagaaggataacaaagactcgaaagcaacttcagaaagagaagcatgtggtttggcaattttttcaaaacagatatcaaagttatctgaagaatatttcattctgcagaaaaaattgaatgaaatgattttgtcacagcaactgaagtcactttatctgggtgtctcgcaccataagccaattaatagacgagtttcttctcagcagtgcctctcagaagtcaatccaagaagaaaaacgaagaccaaggaaagacagtcagggaaaattattagatttggaagatttctattataaggaatttttgcccagtcgttctggaccaaaggaacatagccctagtttaagagaacgaagaccacagcaagaactccagaatcaatgtattaaggctaatgaaaggtgctgggcggcggagagccccgagaaggaggaggagagagagccagcagccaacccctacgacttcaggaggctcctgcgcaaaacctcccagcgccggcgcctcgtccagcagtcctaaccgttcaacgaggcagtcaccgccgtcggaaggcgctggagcctgcggggcagcaggggccaagcaggcactctggggctggcaccagcaggcactgaagctgcggccctgatctccgcagaggctgcctgctgcgctcggccctcaagtgcccgggccggccttcgtgctccgaaacaagagacctgggagccctcgggaaacctcccccgacgctctctctcggaactcccgcaccctcctttctcaccagcccgccagttgtggcaaccctgtccttgttcccctaatctatcactttgttctttttttttgtgactcctgtggactccactgcgcctgggatctcgccaacccctctctcatttggggtgactgaattcacagatttttttttttattggaaacggcttttcttggccaacagaacacttgctagcggttgaatcttagagaaaaaagcccgggaggggtggggagaatttcgaagatgtatttcatctcaagcttgctctttctcttcctttggttattaaggtcactaaataaaggaagtgccttggaaaacccgtgg

SEQ ID NO: 300739 - DNA, 2544 bp, Homo sapiens
caaaggtgaaaacacaatgctcaaatttatacagactggactgggtttccatcagtttggaatttggtctactccgaagttgttctgaggatgcctaaaggatttctccgcatcaagtctgggcatctcttcctcagcccctgcactaagttgttggggaaccaccaagctacagagatgttggcactttatgcaatactaaccagcccttttttccattccaaggtactaccttctctgctacaagtcgagcgaggagccccgcatgagccctgacacctgtgccaccattttggaaaaagctggtctcgataactgggctcttggaaaaacaaaagtgttccttaagtattatcacgtggagcagttaaatctaatgcgaaaggaagctattgacaagcttattttgattcaagcttgtgtcagagcattcttgtgttcaagaagataccaaaaaatacaggagaaaaggaaagaaagcgctataataatacagtcagctgcaagaggacaccttgtcgggaaacaaagaaaagaaattgttgacatgaaaaacacagcagtaacaaccattcaaacttctgatcaggaattcgactacaagaaaaactttgaaaatacaagggaatctttcgtgaagaaacaagcagaaaatgcaatctctgctaatgaaagattcatttcagctccaaataataaaggaagtgtatctgtagtgaagacttccactttcaaacctgaagaggaaaccaccaatgctgtggagagtaacaacagagtgtatcagactccaaaaaaaatgaataatgtgtatgaggaagaggttaagcaagaattttaccttgtagggccagaagtaagccccaaacagaagtttgtcaaagacctggaagagaacagcaatctaaggaaagtggagaaagaggaagctatgatccagagttactatcagaggtacacagaggagaggaattgtgaagagtcaaaagcagcatatctagaaaggaaggccatatcagaaaggccaagctacccagtgccttggttagctgaaaatgagacttcctttaaaaaaactttggaacctacacttagccaaaggtcaatttatcaaaatgcaaacagcatggaaaaagaaaagaagacatctgtagttacccagagtgcaccgatatgcagccaggaggaaggcagaggccgtctgaggcatgagacagtcaaagagaggcaagttgaaccagtgacacaggcccaggaggaagaagataaagcagcggtattcattcagagcaaataccggggttacaagagaaggcagcagttgaggaaggacaagatgtcttcttttaagcatcagaagattgtcacaacaccaacagaagtagcaagaaacactcataatttgtattcctatcccacaaaacatgaggaaatcaataacatcaagaagaaggataacaaagactcgaaagcaacttcagaaagagaagcatgtggtttggcaattttttcaaaacagatatcaaagttatctgaagaatatttcattctgcagaaaaaattgaatgaaatgattttgtcacagcaactgaagtcactttatctgggtgtctcgcaccataagccaattaatagacgagtttcttctcagcagtgcctctcagaagtcaatccaagaagaaaaacgaagaccaaggaaagacagtcagggaaaattattagatttggaagatttctattataaggaatttttgcccagtcgttctggaccaaaggaacatagccctagtttaagagaacgaagaccacagcaagaactccagaatcaatgtattaaggctaatgaaaggtgctgggcggcggagagccccgagaaggaggaggagagagagccagcagccaacccctacgacttcaggaggctcctgcgcaaaacctcccagcgccggcgcctcgtccagcagtcctaaccgttcaacgaggcagtcaccgccgtcggaaggcgctggagcctgcggggcagcaggggccaagcaggcactctggggctggcaccagcaggcactgaagctgcggccctgatctccgcagaggctgcctgctgcgctcggccctcaagtgcccgggccggccttcgtgctccgaaacaagagacctgggagccctcgggaaacctcccccgacgctctctctcggaactcccgcaccctcctttctcaccagcccgccagttgtggcaaccctgtccttgttcccctaatctatcactttgttctttttttttgtgactcctgtggactccactgcgcctgggatctcgccaacccctctctcatttggggtgactgaattcacagatttttttttttattggaaacggcttttcttggccaacagaacacttgctagcggttgaatcttagagaaaaaagcccgggaggggtggggagaatttcgaagatgtatttcatctcaagcttgctctttctcttcctttggttattaaggtcactaaataaaggaagtgccttggaaaacccgtgg

SEQ ID NO: 300740 - DNA, 5218 bp, Homo sapiens
cttaattctagaagggagcgcccgtagccagcgcccccgtaaagaaataaggaggcgcccggcttcccgcccaggcccagggccccagtgcagcctggacacagtattcaaagttttggcgtctgagcattgttatgcgttattttcaagctttgctaacggtttttaaacctttgagatgtttccattaattggaaaaacaatcatctttgataactttcctgatccttctgatacatgggaaatcactgagacaattggcaaaggaacttatgggaaagtttttaaagtattgaataagaaaaatggccaaaaagcagcagtcaaaattcttgatccaattcacgatattgacgaagagattgaagcagaatataacatcttaaaagcactttctgaccaccctaatgtggtcagattctatgggatatactttaagaaggataaagtaaatggagacaagctgtggttggttcttgagctctgcagtggaggatcagtgactgaccttgtgaaaggatttctgaagaggggtgaaagaatgagtgagcctctaattgcctatattttacatgaagcactaatgggacttcaacatttgcataacaacaaaactatccacagagatgtgaaaggcaataacattctattgaccacggaaggtggagtgaaactagtagattttggtgtgtctgcacagctcaccagtacccggcaccgtcggaacacatccgtaggaacaccgttttggatggctcctgaggtgattgcatgtgaacagcaattggataccacttatgacgccagatgtgacacttggtccctgggtatcacggccattgagctgggtgatggagatcctccactagctgaccttcatcccatgagagcactcttcaaaataccaaggaatccacccccaaaactaaggcagcctgagctatggtcagcagaattcaatgacttcataagcaagtgcttgactaaagattatgaaaagcgtccaacagtgtcagaacttttacagcataaattcattactcaaattgagggcaaagatgtgatgctacaaaaacaactaacggaattcattggcatccatcaatgcatgggaggcacagaaaaggccagacgtgaacgtattcacacgaagaaagggaacttcaaccgacctctaatatccaatctgaaggatgtagatgatttagcaaccctagaaattttggatgagaatacagtctcagagcaacttgagaagtgttattccagagatcagatctacgtctatgtgggagacatactcattgctcttaacccttttcagagtctgggtctttactccacaaagcattccaaactatatattggatcaaagagaactgccagtcctcctcacatttttgcaatggctgacttaggatatcaatctataataacatataattcagatcagtgcattgttatttctggagaaagtggtgctggaaagactgaaaatgctcatcttttagttcagcagctgacagtgcttggaaaggctaataacagaaccttgcaagagaagattttacaagtgaacaatttggtagaagcctttggcaatgcctgcactattataaatgacaattctagcagatttggaaaatacttagaaatgaaattcacctcttctggagcggtagtgggagcacagatttctgaatatctcctggaaaaatcccgagttatccaccaagctattggagaaaaaaattttcatattttttactacatttatgctggtttggctgaaaagaagaaactagcccattacaaactgcctgaaaataagcctcccaggtacctacaaaatgaccacctcagaacagtacaagacatcatgaataatagtttctataaatcccagtatgaattaattgagcaatgtttcaaagtcataggttttacaatggagcaacttggtagtatatacagcatactcgctgcaatcttgaatgttggcaacattgaattttcttctgtggcaactgaacaccagattgacaagagccacatttctaatcatacagccctggagaactgtgtttctttgctttgcattcgggcagatgagctacaagaagctctcacctcccactgtgtggtcactagaggagaaacaattatacgacccaatactgtagaaaaagctaccgatgtcagggatgccatggctaaaactttatatggacgtctctttagttggatagtcaattgcattaacagtttgttgaagcatgactcatcaccaagtgggaatggtgatgagctgagcattggcattcttgatatatttggttttgaaaatttcaaaaaaaattccttcgagcagctgtgcattaacattgcaaatgaacaaattcagtattattataatcaacatgtgtttgcatgggaacagaatgaatacctaaatgaagatgtggatgctagagttattgaatatgaggataactggcccctcttagatatgtttctgcaaaagccaatgggtttactttccctacttgatgaagaaagtagatttcccaaggccactgaccagactcttgtagaaaaatttgaaggtaacctgaaatcacaatacttctggagacccaaaagaatggaacttagttttggaattcaccattatgcaggaaaggtcctctataatgcaagtggattcttagccaaaaacaagacactagttcctactgacattgtgctacttttgaggtcatccgacaacagtgtaattaggcaactagtcaaccaccctctgaccaaaacaggtaatctgccacattctaaactaaaaatgttaaactatcaaatgaggacttcagaaaaattaatcaacctggcaaagggcgacactggagaagccacacgtcatgccagagagacaaccaacatgaaaacacaaacggttgcatcatattttagatattccctgatggatttgttgtctaaaatggtggtgggccaacctcattttgtccgttgcatcaaaccaaatagtgagcgtcaggcaagaaaatatgacaaagagaaagttctgctacagcttcggtacacaggaattctggaaacagcaagaattcgaagactaggattctcccatcggatactttttgctaactttataaagcggtactaccttctctgctacaagtcgagcgaggagccccgcatgagccctgacacctgtgccaccattttggaaaaagctggtctcgataactgggctcttggaaaaacaaaagtgttccttaagtattatcacgtggagcagttaaatctaatgcgaaaggaagctattgacaagcttattttgattcaagcttgtgtcagagcattcttgtgttcaagaagataccaaaaaatacaggagaaaaggaaagaaagcgctataataatacagtcagctgcaagaggacaccttgtcgggaaacaaagaaaagaaattgttgacatgaaaaacacagcagtaacaaccattcaaacttctgatcaggaattcgactacaagaaaaactttgaaaatacaagggaatctttcgtgaagaaacaagcagaaaatgcaatctctgctaatgaaagattcatttcagctccaaataataaaggaagtgtatctgtagtgaagacttccactttcaaacctgaagaggaaaccaccaatgctgtggagagtaacaacagagtgtatcagactccaaaaaaaatgaataatgtgtatgaggaagaggttaagcaagaattttaccttgtagggccagaagtaagccccaaacagaagtttgtcaaagacctggaagagaacagcaatctaaggaaagtggagaaagaggaagctatgatccagagttactatcagaggtacacagaggagaggaattgtgaagagtcaaaagcagcatatctagaaaggaaggccatatcagaaaggccaagctacccagtgccttggttagctgaaaatgagacttcctttaaaaaaactttggaacctacacttagccaaaggtcaatttatcaaaatgcaaacagcatggaaaaagaaaagaagacatctgtagttacccagagtgcaccgatatgcagccaggaggaaggcagaggccgtctgaggcatgagacagtcaaagagaggcaagttgaaccagtgacacaggcccaggaggaagaagataaagcagcggtattcattcagagcaaataccggggttacaagagaaggcagcagttgaggaaggacaagatgtcttcttttaagcatcagaagattgtcacaacaccaacagaagtagcaagaaacactcataatttgtattcctatcccacaaaacatgaggaaatcaataacatcaagaagaaggataacaaagactcgaaagcaacttcagaaagagaagcatgtggtttggcaattttttcaaaacagatatcaaagttatctgaagaatatttcattctgcagaaaaaattgaatgaaatgattttgtcacagcaactgaagtcactttatctgggtgtctcgcaccataagccaattaatagacgagtttcttctcagcagtgcctctcagaagtcaatccaagaagaaaaacgaagaccaaggaaagacagtcagggaaaattattagatttggaagatttctattataaggaatttttgcccagtcgttctggaccaaaggaacatagccctagtttaagagaacgaagaccacagcaagaactccagaatcaatgtattaaggctaatgaaagaatccatctaaactatgatatttgccctttgcctccaaaagaagatgtgctcttccatcttgggatccagcactgtaacatgttggagcttagagatgttctagtctaatctcagagctctgtacagaagaacaccaaatgccagaaagattaagtgatttgcccaagatcacacactgagttagtgaactaaaatcccagatgttcactccctgcccatttgcttttcactgacttacctgcttcccattttaaaagctcaccctgccccttctccaatgtatccttccccttccccccactggcagatacacatctgctatgaaagcgttctattcctgaaatactcctgatgtagattaagtgatgtctatgggtgttatttagtatccactgcaataaatgctagcagctagtatt

SEQ ID NO: 300741 - DNA, 1429 bp, Homo sapiens
cttaattctagaagggagcgcccgtagccagcgcccccgtaaagaaataaggaggcgcccggcttcccgcccaggcccagggccccagtgcagcctggacacagtattcaaagttttggcgtctgagcattgttatgcgttattttcaagctttgctaacggtttttaaacctttgagatgtttccattaattggaaaaacaatcatctttgataactttcctgatccttctgatacatgggaaatcactgagacaattggcaaaggaacttatgggaaagtttttaaagtattgaataagaaaaatggccaaaaagcagcagtcaaaattcttgatccaattcacgatattgacgaagagattgaagcagaatataacatcttaaaagcactttctgaccaccctaatgtggtcagattctatgggatatactttaagaaggataaagtaaatggagacaagctgtggttggttcttgagctctgcagtggaggatcagtgactgaccttgtgaaaggatttctgaagaggggtgaaagaatgagtgagcctctaattgcctatattttacatgaagcactaatgggacttcaacatttgcataacaacaaaactatccacagagatgtgaaaggcaataacattctattgaccacggaaggtggagtgaaactagtagattttggtgtgtctgcacagctcaccagtacccggcaccgtcggaacacatccgtaggaacaccgttttggatggctcctgaggtgattgcatgtgaacagcaattggataccacttatgacgccagatgtgacacttggtccctgggtatcacggccattgagctgggtgatggagatcctccactagctgaccttcatcccatgagagcactcttcaaaataccaaggtcagatgactaacattgggtccagtatctgcagcccgatttacttcctccagccaccaagtgttcatcatgctcttcatggagacgttcagatatattccaacaagttgggagcagaagatcctggaatattattctgcttcttctgagacattgtatttgttcagtagttgcatttccctggtctaagtaaaagagctttctcttgataatcagtgtgtctttctctcttttgctaggatttgatttcagaaaatagcagttcctcccaccctttatccattccccaatgagtcagtgaggcatcagagtccatagcctgtgcaagtgttttgctttgctttacctaccaatctagtaattttttactacttgctaagatttccctttgttcagaactttaaaataatattattaagaaaattatatataaaatttatccagaaaataatggttttaaacatgttagtattttgaatatgttaatataaaacaataaatttagaagaataacctcttt

SEQ ID NO: 300742 - DNA, 1833 bp, Homo sapiens
cacctaggccaaccccacaccatgagaatctcctaaacactactttctctgagggctgcctggctggttccttgaatgcctccagtgagctatgggctccctacatcccaaggacatctgggaccagtctcttcagaaagccatgacccaaaggacttggacaaacagttcacagaagataaaatacaatttgttaacaaacataggtcaaagtgttcacccatcattagtaattaaagcaatgcaagttaaagtaatgcaaaagtactttataacagagacaaactagccatatcttaattaagtggtcatacattgctgaacattgtaaaatgctgtaagcttactgaaattattcaacatccatacaaagatccatagcctttctttcaagagacttaaccaaaggaaattcattcattcattcaccaatccatccttccgcctatccttccaccctcttatccatcagccaaacactcactcactcgttccttcctccattcttccatccactcattcatcatttatttatagtctacaacatgttgggcatcagagatacaaaggccaattcaataagctccttgcccttatggggctcacagtctagcaggggaaactgatctgtagtgaagcaatgataatttctgggtggaagaacataattcttaagaatgaaaaaaagggtgttttaagcagttagttgtggcattattcataatatttttaaaaggtggttatacataagaataacagaatggttctgtgaatgacgccatagccactcaacaaggcacaacgcagcaagtgaggttatgaagattcatggaacaagggaaaatgttgatgacagaaaattaaatagaagaggcaggatacaaaaaaaaaaaagtatatgtggtgaataatggcaattaggtttttttaaagaagggatgctcattaaagaatagacactctttttttaaaaaaagtatgcctgtaagaatgtaaaatgggtgacatgtcagaatgttgagtggtgcatgcatttcccactgctctaggtcaagtgccatccacaccatttatattaggaacacaacgggacacagcaggattcgtggcctgtctatcccagaggtcctgaggccaagcttcccaaggagggagttgggagtcacaagaggaggccaaggagagttgtagctcctggtgtcaccaggaaaggatttgtgtgtggggagcatgcaaatgacaatgtcaagagacagaattaattctcattgttaaaagtttaacgaacacataaagataggccctgaccagacaggagcactaggatcccaactcggaccttgtgggtctggtacagaaagaaccgggtagggagcacgtgaaggatgttttatctctggcttttgtgccattaggaaccctatcccgaatctcagcatcccagaactaaagaacctttgaattacagatacaaaactcttaagggtcaaaaccctaagagccctgatcccccctcatggcctccacatttccaaaaggacacacagaattcatccaacccaaacccacccagcctccagggcaccagtgggtctccccagagctgctctcattggctcagttcgacccactgtgacccgtcaggacagcccctagatgttgggagcaggctctcctagcagccaacgtcgcttgttccttccaatttcctcttggtgcatgcaatgggccctcccttccccgccttctgcacactttaagtcttcctgagcctctgctgactttttttaacagccgtacatgagttcttttgaaagaccctcccggtcttct

SEQ ID NO: 300743 - DNA, 2619 bp, Homo sapiens
gacagccaaatggtgcgacaggaggagctgcagccgcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccctacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctaggtatgtgtctgagattttaagcatctcttatacaaagttattgggacattcttacgtactgattatagcaggtgtactgagtcttgcttttttcccaagtagtattttgaaagtagtgttctgtttacttaaaaagtaaattgtttgctttaattttaaagctgtttaaaatacagactttctattactgttttggtgagttactttatcttctataagtgattctacagtaaccaaattggactttgatcttgagcctgaacctcctccagccccaccacgagcttcttctcttggagaaatagatgaatcttctgaattaagagttttggatataccaggacaggcaagccattttaaaccttgcataattcctcttcactgaatgaattagcaataaaagcatcatagtgaataaggcgtgtctttccatttaaaattgccactgaactgtgaatttatggttttttgtttgttttttgtttttgtttttgttttttgagacggagtctcgctttgtcgcccagactggagtgctgtggcgcgatctcggcttactgcaacctctgcctccagggttcaagcgattctcctgcctcc

SEQ ID NO: 300744 - DNA, 5652 bp, Homo sapiens
gacagccaaatggtgcgacaggaggagctgcagccgcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccctacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcaaaaataatttgatgaaatattttatacaactcttcaaaggatccgtctgtggctttttatactcttttagggttgtctttttacaaaccatgactttccacttgcctgtagttttttgtttgtttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcattttgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgta

SEQ ID NO: 300745 - DNA, 5770 bp, Homo sapiens
gacagccaaatggtgcgacaggaggagctgcagccgcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccctacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcaaaaataatttgatgaaatattttatacaactcttcaaaggatccgtctgtggctttttatactcttttagggttgtctttttacaaaccatgactttccacttgcctgtagttttttgtttgtttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcattttgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgtaactttggttttaagtattctttccttttagaaacttcctaatgattaaaatatactttaacttttctgtgttcaaaatctcaaagactaattaactttaataaacattcttgcaagta

SEQ ID NO: 300746 - DNA, 6588 bp, Homo sapiens
gacagccaaatggtgcgacaggaggagctgcagccgcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccctacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcaaaaataatttgatgaaatattttatacaactcttcaaaggatccgtctgtggctttttatactcttttagggttgtctttttacaaaccatgactttccacttgcctgtagttttttgtttgtttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcattttgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgtaactttggttttaagtattctttccttttagaaacttcctaatgattaaaatatactttaacttttctgtgttcaaaatctcaaagactaattaactttaataaacattcttgcaagtaaaaaaaaaaaaaaaaaaaaaaaaaaaaaaaaaaaaaaaaaaaaaaaaaaaaaagagggcgcgggaccccaaaagaaatccccacgaggggaccccaactctttagcgcgcgtcaccagattttctgtgaaacaaagaggggccccacaaaaggggcgccgctataacaaaagcaagacgagagggacaccgccataaaaacagccgcgggagagtgcggaaacaacctgcatgactgagaaacctaggggcaacaaaccaacacccacatcgggggggcggagaaaatatgctgcgggacaaaacccacaaggaaaaattacaacacaccacaccgagacaacatacacaaaagaacgcggtcatcacagaggggtacacaacaacagcaggactaaacaacgagcgacagaaaacaatctcgcgacccaaatgaacaaagactgccgactaagcatattataccacagggacagtgccaaaaaaaaacagacaaagcacaaccaatacacagcagcacacaaataacacgcaaaaaaataagacaaagagacagagagaataactacaaggaccaacacagaagcagaagaacaagacagagagacgcaggcggagacaaggagaagagctagacgaaacagacgcgaccagcgcggcagaagaaacacacacagaagaagaaacgtaccgagtagaaggaagacagcagaaaagggtaggcagcacggaagacaagacaagagagaaacacgaccaagaggagcacagacgacaggaacacagcagaaagcgcagaacccacaaacagtaatagaa

SEQ ID NO: 300747 - DNA, 5575 bp, Homo sapiens
  misc_feature (5551)..(5551): n is a, c, g, or t
gacagccaaatggtgcgacaggaggagctgcagccgcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccctacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcaaaaataatttgatgaaatattttatacaactcttcaaaggatccgtctgtggctttttatactcttttagggttgtctttttacaaaccatgactttccacttgcctgtagttttttgtttgtttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcattttgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattctatggntgtcgtggatcctctagaatcagc

SEQ ID NO: 300748 - DNA, 5716 bp, Homo sapiens
gacagccaaatggtgcgacaggaggagctgcagccgcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccctacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcattttatactcttttagggttgtctttttacaaaccatgactttccacttgcctgtagttttttgtttgtttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcattttgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgtaactttggttttaagtattctttccttttagaaacttcctaatgattaaaatatactttaacttttctgtgttcaaaatctcaaagactaattaactttaataaacattcttgcaagta

SEQ ID NO: 300749 - DNA, 5466 bp, Homo sapiens
gacagccaaatggtgcgacaggaggagctgcagccgcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccctacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacagatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcaaaaataatttgatgaaatattttatacaactcttcaaaggatccgtctgtggctttttatactcttttagggttgtctttttacaaaccatgactttccacttgcctgtagttttttgtttgtttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcattttgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgta

SEQ ID NO: 300750 - DNA, 3905 bp, Homo sapiens
gacagccaaatggtgcgacaggaggagctgcagccgcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacagattgcccaaggactccagatactccaaataatgaccctcgttgttctactagcaacaatagattgaaggccctacaaaaacaattggatatagaacttaaagtaaaacaaggtgcagagaatatgatacagatgtattcaaatggatcttcaaaggatcggaaactccatggtacagctcagcaactgctccaggacagcaagacaaaaatagaagtcatacgaatgcagattcttcaggcagtccagactaatgaattggcttttgataatgcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccaatgatgtctgtgctgttttgaagctcgataatactgtggttggccaaactagctggaaacccatttccaatcagtcatgggaccagaagtttacactggaactggacaggtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggttaccttttttaatccagttattgaaagaagaccaaaacttcaaagacaaaagaaaattttttcaaagcaacaaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctagtgattctacagtaaccaaattggactttgatcttgagcctgaacctcctccagccccaccacgagcttcttctcttggagaaatagatgaatcttctgaattaagagttttggatataccaggacaggattcagagactgtttttgatattcagaatgacagaaatagtatacttccaaaatctcaatctgaatacaagcctgatactcctcagtcaggcctagaatatagtggtattcaagaacttgaggacagaagatctcagcaaaggtttcagtttaatctacaagatttcaggtgttgtgctgtcttgggaagaggacattttggaaaggtgcttttagctgaatataaaaacacaaatgagatgtttgctataaaagccttaaagaaaggagatattgtggctcgagatgaagtagacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtattttatgctgcttgtgtagttcttgggttgcagtatttacatgaacacaaaattgtttatagagatttgaaattggataacttattgctagatacagagggctttgtgaaaattgctgattttggtctttgcaaagaaggaatgggatatggagatagaacaagcacattttgtggcactcctgaatttcttgccccagaagtattaacagaaacttcttatacaagggctgtagattggtggggccttggcgtgcttatatatgaaatgcttgttggtgagtctccctttcctggtgatgatgaagaggaagtttttgacagtattgtaaatgatgaagtaaggtatccaaggttcttatctacagaagccatttctataatgagaaggctgttaagaagaaatcctgaacggcgccttggggctagcgagaaagatgcagaggatgtaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggatcagcgctgatccgcttaagggaaactgagtgcttgattgagtctctcatttgcgtctttcatttattttatggcagtgtcagtatttcattctcataattataatgtgttttttggcagtaattcattgtgtaaattatacaccgtgttgtccatgttaggtggagaaaatgtagaagacagaagtgtcttgcataataagttgtttaagtgactaggcctcagaattgttgaattgtggttagtagact

SEQ ID NO: 300751 - DNA, 2788 bp, Homo sapiens
actttaaaagctgtttttcagttcataaatgttgcatggcttagacaaaaaaagacaaaatatatctaagttttttaaagtaataatccttatcagtgaattttattctattggttttattttaacttttttattttacattatgctagctgttaagaagaaatcctgaacggcgccttggggctagcgagaaagatgcagaggatgtaaaaagcacccatttttccggctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcaaaaataatttgatgaaatattttatacaactcttcaaaggatccgtctgtggctttttatactcttttagggttgtctttttacaaaccatgactttccacttgcctgtagttttttgtttgtttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcattttgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgta

SEQ ID NO: 300752 - DNA, 459 bp, Homo sapiens
atttgtaactttggttttaagtattctttccttttagaaacttcctaatgattaaaatatactttaacttttctgtgttcaaaatctcaaagactaattaactttaataaacattcttgcaagtactttttgtcctagtgaaggcttaaaaccatgaacattcagagcaaactgtccacttcattgggaataatgggaaaagtttgtattctgctcctgtaaggtcagtagcatcttttatttgaagcatatttatggactgcttactgtgtatagatactgagaataggaagtttttttttttaaagcaacaaaatgttgatgaatgaagaacagcctgttttaattaagatgcaagcaccagtattgtatgtacttttctcttgtttgaggttagcttattttaatttaggacctggcttctcaaaaaggcaaatgaataaaacagaatactagtat

SEQ ID NO: 300753 - DNA, 905 bp, Homo sapiens
cagattttcaggttgattgatgtgggacagcagccacaatgaggaactcctatagatttctggcatcctctctctcagttgtcgtttctctcctgctaattcctgaagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtgggggaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaaatcaatttgcatgactgtaaaaaaaaa

SEQ ID NO: 300754 - DNA, 1240 bp, Homo sapiens
gatacgaaataagtcttccaagcacgcaagaaccgccatagctgcaactgactctcttaattttccaccgctacacgctggaagttaaagcaaccatgagcaaagctgtaggaaacttcatctaccaaaaacaggacaggatgtaaaacttcacaccgagtgtcatgtggcaggatggggaagcacaaaaagagactcatgcaaagttttgaaaacaccttgagagaagtgaacaaacatcactatgatggaccaaaaaacatgcaatgatgcagagcactataatttcaagctggttgttgaaaactgcatgatctgtgctagtggtagaaaaggtgaagatgcggggaggcttccaagatggccaaataggaacagctccaggctgcagctcccagcgagatcaatgaggaagacaagtgatttctgcatttccaactcagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtgggggaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaaatcaatttgcatgactgtaaaaaaaaa

SEQ ID NO: 300755 - DNA, 1271 bp, Homo sapiens
gatacgaaataagtcttccaagcacgcaagaaccgccatagctgcaactgactctcttaattttccaccgctacacgctggaagttaaagcaaccatgagcaaagctgtaggaaacttcatctaccaaaaacaggacaggatgtaaaacttcacaccgagtgtcatgtggcaggatggggaagcacaaaaagagactcatgcaaagttttgaaaacaccttgagagaagtgaacaaacatcactatgatggaccaaaaaacatgcaatgatgcagagcactataatttcaagctggttgttgaaaactgcatgatctgtgctagtggtagaaaaggtgaagatgcggggaggcttccaagatggccaaataggaacagctccaggctgcagctcccagcgagatcaatgaggaagacaagtgatttctgcatttccaactcagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtgggggaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaaaatccgatgcgggccgattaaattataatatataaatatttccatttacatactagac

SEQ ID NO: 300756 - DNA, 1268 bp, Homo sapiens
gatacgaaataagtcttccaagcacgcaagaaccgccatagctgcaactgactctcttaattttccaccgctacacgctggaagttaaagcaaccatgagcaaagctgtaggaaacttcatctaccaaaaacaggacaggatgtaaaacttcacaccgagtgtcatgtggcaggatggggaagcacaaaaagagactcatgcaaagttttgaaaacaccttgagagaagtgaacaaacatcactatgatggaccaaaaaacatgcaatgatgcagagcactataatttcaagctggttgttgaaaactgcatgatctgtgctagtggtagaaaaggtgaagatgcggggaggcttccaagatggccaaataggaacagctccaggctgcagctcccagcgagatcaatgaggaagacaagtgatttctgcatttccaactcagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtgggggaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaaacaagatgcggccgttttggtgcaaattgtggtctcttccgaccgatcctgagcc

SEQ ID NO: 300757 - DNA, 908 bp, Homo sapiens
actcagctcgcctgcacccaggtgaaataaacagccttgttgctcacacaaagcctgtttggtggtctcttcacatggatgcgagtgaaatttacttttgttgaaaactttatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtgggggaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaaatcaatttgcatgactgtaaaaaaaaa

SEQ ID NO: 300758 - DNA, 1268 bp, Homo sapiens
gatacgaaataagtcttccaagcacgcaagaaccgccatagctgcaactgactctcttaattttccaccgctacacgctggaagttaaagcaaccatgagcaaagctgtaggaaacttcatctaccaaaaacaggacaggatgtaaaacttcacaccgagtgtcatgtggcaggatggggaagcacaaaaagagactcatgcaaagttttgaaaacaccttgagagaagtgaacaaacatcactatgatggaccaaaaaacatgcaatgatgcagagcactataatttcaagctggttgttgaaaactgcatgatctgtgctagtggtagaaaaggtgaagatgcggggaggcttccaagatggccaaataggaacagctccaggctgcagctcccagcgagatcaatgaggaagacaagtgatttctgcatttccaactcagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtgggggaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaaaaggatcgcgcccagaccttctttccctggtccgctcgcggacccctccgccgtg

SEQ ID NO: 300759 - DNA, 1268 bp, Homo sapiens
  misc_feature (1237)..(1237): n is a, c, g, or t
gatacgaaataagtcttccaagcacgcaagaaccgccatagctgcaactgactctcttaattttccaccgctacacgctggaagttaaagcaaccatgagcaaagctgtaggaaacttcatctaccaaaaacaggacaggatgtaaaacttcacaccgagtgtcatgtggcaggatggggaagcacaaaaagagactcatgcaaagttttgaaaacaccttgagagaagtgaacaaacatcactatgatggaccaaaaaacatgcaatgatgcagagcactataatttcaagctggttgttgaaaactgcatgatctgtgctagtggtagaaaaggtgaagatgcggggaggcttccaagatggccaaataggaacagctccaggctgcagctcccagcgagatcaatgaggaagacaagtgatttctgcatttccaactcagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtgggggaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaaacccggatgcggccagcccttctntctataacactatctaaaagcggtcaaaaaa

SEQ ID NO: 300760 - DNA, 1282 bp, Homo sapiens
  misc_feature (1219)..(1219): n is a, c, g, or t
gatacgaaataagtcttccaagcacgcaagaaccgccatagctgcaactgactctcttaattttccaccgctacacgctggaagttaaagcaaccatgagcaaagctgtaggaaacttcatctaccaaaaacaggacaggatgtaaaacttcacaccgagtgtcatgtggcaggatggggaagcacaaaaagagactcatgcaaagttttgaaaacaccttgagagaagtgaacaaacatcactatgatggaccaaaaaacatgcaatgatgcagagcactataatttcaagctggttgttgaaaactgcatgatctgtgctagtggtagaaaaggtgaagatgcggggaggcttccaagatggccaaataggaacagctccaggctgcagctcccagcgagatcaatgaggaagacaagtgatttctgcatttccaactcagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtgggggaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaaagattnagcaagcgagccagaattttaatgggtttataatatatacaatatacataataataatatacg

SEQ ID NO: 300761 - DNA, 874 bp, Homo sapiens
gatacgaaataagtcttccaagcacgcaagaaccgccatagctgcaactgactctcttaattttccaccgctacacgatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtgggggaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaaatcaatttgcatgactgtaaaaaaaaa

SEQ ID NO: 300762 - DNA, 622 bp, Homo sapiens
gtgcccctgttgtaaaaactcacaataaagaggatcctgaaattttggactataatttaaaatgtaaatatttatcttatcccattaacactttatgtttttcttccaacagctgacggaaaaagcaaaaattaacaaatatgtgactatccttcatctacctaaaaagggggatgatgtgaaaccaggaaccatgtgccaagttgcagggtgggggaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaaatcaatttgcatgactgtaaaaaaaaa

SEQ ID NO: 300763 - DNA, 471 bp, Homo sapiens
attcataaacattcttttattctttaaagcacacattttctttctgagccacaaagaaatctccccacctccatatttacaaatgggacaatgaaactgatcagtatatatgctcaactgccaatacaaagaataaatccagtaaataatgttgtgtctgttctcaggaacaaaaggtcccaggtcattcttggggctcactcaataaccagggaagagccaacaaaacagataatgcttgttaagaaagagtttccctatccatgctatgacccagccacacgcgaaggtgaccttaaacttttacaggtacgtatctttgattgtcttctcaaaagtcatagaaccttctacaatctggccgccgacgtgaaaacctttccttggtgcccctgttgtaaaaactcacaataaagaggatcctgaaattttggactataatttaaaatgtaaatatttatcttatcccat

SEQ ID NO: 300764 - DNA, 513 bp, Homo sapiens
agatgagtctttggctcagcagaatgggcctaggtggagcttgaaattaatgaagagatgctgcttccagctttttgagcaagaagaagtttggcctccagttattacaccttgaggtcagcgggtatctcaagtctgagtagttataaaagtgagctgatgtagaaacaccaccaaagcaacgttttatctaaatatttcagatcccccattataaatcatttattatgattacccttttggtgtcatggaatgagatgatgagcttttcttaatgaagtatttcatagacatattttttccatttatcttggtgttggatgctatgtgacctgaatggcaaatgaggaaatatttgtgcaactcctgaaatgcacacatctccccatgccagagtgcaggagcggacagggctttccctggcagcaatagggagcccggtcctggagtagggcctctccagccctgactggcacccatagcaggtgacatctgacttggggtgtgccatgt

SEQ ID NO: 300765 - DNA, 3306 bp, Homo sapiens
aggcagcggcggcggctgcgggcgtagcgggccggagccgacgcggcggcgggcaccgcgggcaccgcgcacgccgctgccccaggggcgccccggccggccgcgcgcacgggccccgcgggacgggccacgcgggggtgggaggggcccgggccacgcgcgccgccgccgccgcccacgcgcgaccctcgggggcccggccgcgacgcacctttgtccgggggggggcccccccgcttcatgccgccgcccccccccacgcgccgcgtgcccggccgcgcagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaaaaaaaaggagaaggagcgccgggtggccaataacgcccgggagcggctgcgggtccgtgacatcaacgaggccttaaggagctggggcgcatgtgccaactgcacctcaacagcgagaagccccagaccaaactgctcatcctgcaccaggctgtctcggtcatcctgaacttggagcagcaggtgcgaggtaggctccccggccagggctgccccagcaccctctcccttccccgcacccaggtgcagatgctggggtcctccgtgtgcttgccgccc

SEQ ID NO: 300766 - DNA, 2192 bp, Homo sapiens
aaattaaggctaggtagaggccggtgttaatcggccgaggaacacgtcagccagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaagctgggtgggcagtggccccatagcctctggaactgctgtttcttccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatg

SEQ ID NO: 300767 - DNA, 1995 bp, Homo sapiens
cagcaactccgtggccaagctgaggaggcccagggcccgctcctgcttctccacgggtgtgctctgtggcccccgatggaagggggaaggatccaagcaggccctccctgcccagggcagaagattctggagtcctgggcgttgcctgtgagtgttctgagagataagggccccgcccgccccgccccgggaccaaggtcctcgtcccgtcccttgctgcgccgggaactcctgccccacgcaggcttctggtctccacactgggcttgttcctgggtgatgagattcggctccaccctcacgggctgccagcctcctgcccgatgggtgagcctctgctgctgcttcagcaaagggcggccccacttcccacactggcaggtggggacagggagaccctgggcctccccagagctcatgggttagcttccacaccctcatgctgtcatgagcctttctcacagggtcagaagagtctgcatctgacacagagaccccagtccacatagtcagggctgggccagagggagggacttggggctgatggggaggaggctcggcgtgagagtgaggtctttgcccaaggagggtatgaaagctggggctttagtgggtgggtaggagttggccagcagagagccgacggaagagttaatttaagtttatggacctgtaagtgctccgagtcccagggtgtctgggtgttagctgctgactggtgtcctcatgagtcgggctgggtgaggctgggttaggaagggttccacaagccccccgggtccactgaggtttgcccctgagatgatgaaccgaagcttttagagctgggcaggcgtgagggtgacccataactctctctgtcctgcctgcaggtcttgaggaccggcccagctcaggctcctggggcagcggcgaccagagcagctcctcctttgaccccagccgggtaggagtccccgtgaggcctgagaccctgagtttcctgtccccagagttgggggcgaggggtgtggggaaactgaggctgagagaaggggccagccttccaggggtttggactgggggacatgggtttgagtcctgcctctccagctgtaatgcggggtggagggggggcctgtgaagccccagcacctctcatccccaccccatctcccctagaccttcagcgagggcacccacttcactgagtcgcacagcagcctctcttcatccacattcctgggaccgggactcggagggaggtgagtgcctggcctggtgcggtccctctgctgtgcacagatgtgcagacgtgggccttggcatggtcagtgcacgcacagcgccaggcaagtccccagcgttcacccagagggtgtggacagccgaagcctctgcccgtcctgggagcagctgcggggaggtgcaggggacgtggcccggactccctggcacggcactctgcaactaggcttccccgcctgagcgtagaggcagggaggccgttccagaccccacttcctccctgggatttctgcagggctcctcctgcttcccggggaggggtcagccgggctggcctgtgcccgctgggaaggaggcgtaggagttctggagactcgggagggcggccagagtgtgcggtggtcagagcccatgcccttccgcagaccgcccgcccgccctctttccctggggggccctcctgttaaccgagagaatcgtgactcaggttgggctcggtggctcacgcctgtaataccagcactttgggagagcgaggtgggtggatcacctgaggtcaggagtttgagaccagcctggccaacatggtgaaaccccgcttctaccaaaaacacaaaaattagccggtcatggtgttggatgcttatagtgccaactactcaggaggctgaggcaggagaattgcttgaacccaggaggtggaggctgcagtgagccgagatcacgccattgccctccagcctgggtgatggagcgagattccatctt

SEQ ID NO: 300768 - DNA, 4447 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgat

SEQ ID NO: 300769 - DNA, 4753 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccgggtaggagtccccgtgaggcctgagaccctgagtttcctgtccccagagttgggggcgaggggtgtggggaaactgaggctgagagaaggggccagccttccaggggtttggactgggggacatgggtttgagtcctgcctctccagctgtaatgcggggtggagggggggcctgtgaagccccagcacctctcatccccaccccatctcccctagaccttcagcgagggcacccacttcactgagtcgcacagcagcctctcttcatccacattcctgggaccgggactcggagggaggtgagtgcctggcctggtgcggtccctctgctgtgcacagatgtgcagacgtgggccttggcatggtcagtgcacgcacagcgccaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgat

SEQ ID NO: 300770 - DNA, 4116 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaagcagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgat

SEQ ID NO: 300771 - DNA, 4704 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgatacacacacaaacccaccaacccgggcccccaatcagcggggcccggcgacacaggcgtacgcacgggccgtgcccacgcggtcccttacccggttctgtaccacgtgcaatcggcgcgcccccaagtggcgataatcgacacaggtactgtttacgactgccaggacacacccacccggtaacggaccagttcaaacggcacggacactaaatctgccacaaaaaccgatgagtcgacaaccactacccgcatacac

SEQ ID NO: 300772 - DNA, 4394 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgat

SEQ ID NO: 300773 - DNA, 4674 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgat

SEQ ID NO: 300774 - DNA, 4412 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgat

SEQ ID NO: 300775 - DNA, 4639 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgat

SEQ ID NO: 300776 - DNA, 4422 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgat

SEQ ID NO: 300777 - DNA, 4438 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgat

SEQ ID NO: 300778 - DNA, 4107 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaagcagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgat

SEQ ID NO: 300779 - DNA, 3624 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagaggcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgat

SEQ ID NO: 300780 - DNA, 4528 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggtgagcgctgggcgagggtggagctgggcagtgggcggggacccggctccccctgatgcacccgtctccccacgcctgcaggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgat

SEQ ID NO: 300781 - DNA, 2772 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaa

SEQ ID NO: 300782 - DNA, 3962 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaagcagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgat

SEQ ID NO: 300783 - DNA, 4288 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgat

SEQ ID NO: 300784 - DNA, 3051 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaaaaaaaaggagaaggagcgccgggtggccaataacgcccgggagcggctgcgggtccgtgacatcaacgaggccttaaggagctggggcgcatgtgccaactgcacctcaacagcgagaagccccagaccaaactgctcatcctgcaccaggctgtctcggtcatcctgaacttggagcagcaggtgcgaggtaggctccccggccagggctgccccagcaccctctcccttccccgcacccaggtgcagatgctggggtcctccgtgtgcttgccgccc

SEQ ID NO: 300785 - DNA, 2571 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaaga

SEQ ID NO: 300786 - DNA, 3541 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccgggtaggagtccccgtgaggcctgagaccctgagtttcctgtccccagagttgggggcgaggggtgtggggaaactgaggctgagagaaggggccagccttccaggggtttggactgggggacatgggtttgagtcctgcctctccagctgtaatgcggggtggagggggggcctgtgaagccccagcacctctcatccccaccccatctcccctagaccttcagcgagggcacccacttcactgagtcgcacagcagcctctcttcatccacattcctgggaccgggactcggagggaggtgagtgcctggcctggtgcggtccctctgctgtgcacagatgtgcagacgtgggccttggcatggtcagtgcacgcacagcgccaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgat

SEQ ID NO: 300787 - DNA, 2441 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaagcagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaa

SEQ ID NO: 300788 - DNA, 2240 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaagcagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaaga

SEQ ID NO: 300789 - DNA, 2343 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgat

SEQ ID NO: 300790 - DNA, 2296 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaagcagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaataaaagtcccgtgtctctcgctatttctgctgctgttcctagactgagcattgcatttcttgatcaaccagatgattaaacgttgtattaaaaa

SEQ ID NO: 300791 - DNA, 2570 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgat

SEQ ID NO: 300792 - DNA, 2490 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtctgggtgggcagtggccccatagcctctggaactgtgcgttctgcatagaattcaaacgagattcacccagcgcgaggaggaagaaacagcagttcctgggaaccacaattatggggggtggggggtggatttcctttcttaaacaagtttgtttctaatgtatttctttgcatccatgacagtttcctaaaattacacttataatcttttacttataaagaattt

SEQ ID NO: 300793 - DNA, 4030 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaagctgggtgggcagtggccccatagcctctggaactgctgtttcttccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatg

SEQ ID NO: 300794 - DNA, 2446 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggcggggtcttcacacctggagcagctttttccaaatcaaagttgattgacagactcaacaaacacggtattgagtttagtgttattagcagctctgaagtctaaacactggaagaattacctgaagtcataacgtgcgtgaattaacagcttctctatttgatatttgaaattcttctgtaagcttgtctcagtgtatgtggaaacgattgtcaaatctaaaatatctatatattaaaaagtaggaacccgccctagcttaccctaaaaa

SEQ ID NO: 300795 - DNA, 4447 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcgctgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtggccagggcatctcaccgcagcttggtcccctctccacctcgatctacttgctcacccaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaattctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatgggattttctagtttcctgccttcagagtatctaatcctttaatgatctggtggtctcctcgtcaatccatcagcaatgcttctctcatagtgtcatagacttgggaaacccaaccagtaggatatttctacaaggtgttcattttgtcacaagctgtagataacagcaagagatgggggtgtattggaattgcaatacattgttcaggtgaataataaaatcaaaaacttttgcaatcttaagcagagataaataaaagatagcaatatgagacacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgtttatatcaaatgagcatctcaaatgttttctgcagaaaaaaataaaaagattctaataaaaaaa

SEQ ID NO: 300796 - DNA, 739 bp, Homo sapiens
ggcacgagggtgccggccgcgcccagagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagcagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaaga

SEQ ID NO: 300797 - DNA, 711 bp, Homo sapiens
ggctccatcccgtgtcttcctcgacctgctgcctgtctgagcctcggcttccccttttgccaagcaaacccatacccagccctggtagggggacactgggccctaccccccgctccagggaccccctgctccagggcctgccatgcggggccagtgcacacacaggaaacgaggagtcagccagggctcaggcatccggggactctccacatgtccacctgttgagtgtaaacctctcacttttcagagctgaaacgtaaagacaactttgtatcactgtcaagagctgataagttgtatccttcgcctaatgggatacccctccccccagagcaaaggcagggggaacagcgagttttcagcggcagggactctgcctggcggtacagcggggtcatcgtctggagttttctcactctgggcgtgggtgtccagggtgcagcgtcacttgagggcacgcgagtcctcagagtcttctggtctgtgatggggcggagcaggacgggccgggcctagatggagcgcagtctcaggttcccgggtgtccccagctctgctcccagcttgggtttgaacccgggactgtagggtttggtttgccacccgccccgctcacgtctcccctcccctccctgcagatgttcccgctgcctgtcaccaacgggaagggccggcccgcctccctggccggggcgcagttcggaggttcag

SEQ ID NO: 300798 - DNA, 277 bp, Homo sapiens
ggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgaggtaggctccccggccagggctgccccagcaccctctcccttccccacacccaggtgcagatgctggggtcctcctgt

SEQ ID NO: 300799 - DNA, 6320 bp, Homo sapiens
acatgagaggtatgattggtggtggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacacttcctggccaagacacgcagcaccaaggaccagcaattcaagaaggatcagaatgttctctctccagtcaactgctggaatctcctcttaaaccaggtgaagtgggaaagcagggaccataccaccctgagtgacatctacctgaataatatcattcctcgatttgtacaagtcagcgaggactcaggaagactctttaaaaagagtaaagaagtcggccagcagctccaagatgatttgatgaaggtcctgaacgagctctactcggtcatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgtcaagccaagtacacggagaataagctgaaggccatcaaagcccggaatgagtacttgctggctttggaggcaaccaatgcatctgtcttcaagtactacatccatgacctatctgaccttattgatcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacaaaaatgaaagagtacctggagggcaggaacctcatcaccaagttacaagccaagcatgaccttctgcagaaaaccctgggagaaagtcagcggacagattgcagtctagccaggcgcagctcaactgtgaggaaacaggactccagccaggcaattcctctggtggtggaaagctgtatccggtttatcagcagacacggactacagcatgaaggaattttccgggtgtcaggatcccaggtggaagtgaatgacatcaaaaatgcctttgagagaggagaggaccccctggctggggaccagaacgaccatgacatggattccatagctggtgtcctgaagctttacttccgggggctggaacaccctctcttccccaaggacatctttcatgacctgatggcctgcgtcacaatggacaacctgcaggagagagctctgcacatccggaaagtcctcctagtcctgcccaaaaccactctgattatcatgagatacctctttgccttcctcaatcatttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactgtgatagccctcatggagagactacctcggttgaagactcaacccaggatgtgaccgcagagcaccacacgagcgatgacgaatgtgagcccatcgaggccattgccaagtttgactacgtgggccggacagcccgagagctgtcctttaagaagggagcatccctgctgctttaccagcgggcttccgacgactggtgggaaggccggcacaatggcatcgacggactcatcccccatcagtacatcgtggtccaagacaccgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaagcaaaggaagcgtccagaatctgggagcatccggaaaacttttcggagtgacagccatgggctgagcagttccctgactgactcctcctccccaggggtgggggctagctgccgcccatcctcccagcccatcatgagccagagcctccccaaagaagggccagataagtgttccatcagtgggcacgggagcctcaactccatcagccgccactcatccctgaagaatcggctggatagtccacagatccggaagactgccacagcgggaaggtcaaaaagcttcaataaccatcggcccatggaccctgaggtcattgctcaggatattgaggcaacaatgaactcggccctgaatgagctacgggaactagaacggcagagcagtgtcaaacacacccctgacgtggttctggacaccttggagcccctcaaaacctccccagtggtggcccccacgtcagagccctccagccctctgcacacccagctcctcaaggaccccgagcccgccttccagcgcagcgccagtactgctggggacatcgcctgcgccttccggcctgtcaagtctgtcaagatggctgccccggtcaaaccaccagccacacggcccaagcccactgtcttccccaaaacaaatgccactagccctggtgtcaactcatcaacttccccacagtctactgacaagtcttgtactgtctgagggataataatttaattgttctagacaaggggactatagggactgactgttattaaaatcttcctatttaactagcttggggacttcagttgaaaattaggttctaagttgttcttgcaggaattagcctccccgtctcccaaaaccttgagaatgaagcccttggtatcgcctctcccttcccactgccctctgcttcccccagtcgtcgtaattcagccagctgcagtccgtaccgttcttaggttagccagagacaggttttcattatcaggtcactgtgaaatctggtaaggcagtcctgaggacatgggctcaagtctcagtcccctcagaccacggtgatgccttgaccagatggttggctactgccatccagctttcagtggcatcttgttttgggaactgattatagagaatcatatatagtccagtcttcattttacatacacacacatattttacacacacacacattttacacacacacacacacacacacacacatatgtttttctagtctctggcatgtgtagcctctcctggtcatagaccagtctctttgtaagttattgtggcagttcacacagtagccaccaggggtctctgtttccatcacaaactttgttctgtctgggccagagaacctagcctttgaaatctctccatcatatgaaacataacgggatgggacaatcccgtaacctgtttggggttgggggctttctctctgtgttctttccattgatgtgaattggtcattggtgtttgctcttgcctctcctccatcccctagaagtacacccccgtcttattaaggagcttttaaagtttttctgaatgtatagacatttctcgggttcctacctttgtctctgatggaccattttccatttaagacattttcctgtataagacagttttatagctggttccttttagggtaaagagtcttaagagagttttattgtgtctatggcaggtttgggaaaggtaagaaatgggtcctttttcctcctaatgtttttggcacttaaaacataaaattcattatcctattaaaaaattaaattcagctttgctaatccagaaattgttcccaaatgaaaacttgttttaagtccaccccttagtttccttattttacaaggtctctcttcagggaccaacaggggcttagagagccttagttagattaaagggagaccctacctcttaaaaccagttttcatttatgcaaacaaggacaattaagggaaccctgaccccacaggctctcaagtcttcccaaggccagaatcgaaagaaaattaaaatttgaatgctgaatattctggctctactctggccttttttctggttcccttccaaaatgcacaaatcatacccttgtctgctccaattcagtctccaaacctggtgcctgtgctcctggcccccctagcatcatgctatcccaggagtatcaggaccagacacatccacagccaggctcatgggtctcagacagcaacttgagttaaagctgaaactcatccttcttctctgtgttttctggtttaaaagctgcacttatattttagccttattattttctgtagttccggagagatggtgggttgccattctggtaggaaaatctgagttttcttatctttgacctagaagagattctttttggaccaacctgcgaaattggtagttaggtctatggaaagtggtaggatttttttttttttaatcctgtgcaaaggaaaagaggtgctttgtgggaaatcactaatgagaaggctaacctgcagcaccagagaaacctttccaagtgctaggcaggagaactgaagaactctttcagtgaagtgagtcagcctagaagaggcaacccacagtcttgatttttgttgctgtttcctgacctgttcttgcctgtcacctgggcctacacaggtcccgagccaacggggctttcatacccaaggatctgtttccttgctgaaaatgaaaccctatctttcactttacattcctttcaatccaactgatcaaaactggtacccacacttgccctttctccctctctccagcacactcccctctaagaaagtaaaagcaaagctttcttaatggcaacactttgggcctgttctgttgctcctgccttatttctctttcaaccctgtacatgactcgtgttcaccatccccttgatcagtgtccatccgcgctaatttgcatcatgaactgaacagtgtgtgagtggtcacctactaaacccagctctgggggcagagctgtcttccccatctctggtgctcctaacacctgtgagatggtcctgtcgagaggactaggaaccgataggaggagagtccttctcggcagagctcactgcaaacaactggaattgaggttgcacactgtgatttttacaccgaaaagccaaaaggagctggccatccagggcctagggagaccagccttcctcagctatgcttgccgaaaccagcatgatgcttcaaagagccctgctccacccctcatggcatggatccttttcctggtgtggactctgaagggtcagtcttcggggaagagaggtggggtggggctactagcatcccaatttagaaaacagaggagtttgtagccagcagcctgtaaactggaaacactggtctcagccaacctcctcagggcgccctggcttctccccaaggagatgaggagcggtgatgccagcaccgggatgcgcagagcactggaagggctggtgcagatctacttcccatgcagaagagaagtcacatcttccagggaatcgcaatgttgtggcgtctgacttgtatgtcacatttgtgtaaaatggtatattctttaaaatagtgttgataactggaatattgtatgtatgcttggagatgctttgtgtgaacctaagactgtcactcaacagatgttggattggggaaaatccaaagcacaacttcaaaataaaatacatttttaggtttcaaaaaaaaaaa

SEQ ID NO: 300800 - DNA, 519 bp, Homo sapiens
agcattgtgtttctggagccggagctgcctgaggcactcttctccagcctcctcagccttccatggagctgcagaccctacatagacctacccctgccaggctccaaacagatccccctacccattcctttcatgtactgtttggtcctggaagaggctcacacaagttggctttgggttttgcttcaacatagaaaccacgagccttataccttgaatatgggtagtttcattgccagtaatgggaactctggaactgccaaagggactgtatcctctttctgacctggtgttgctttcttttgttaggcttcccagctctgtgcccagcagcctgtccagagtgagctggtacagagatgccaacaactgcagtctcgcttatccactctaaagattgaaaacgaagaggtgagtttcttccttaggaggctcaaagccacactcttagtttccctgttgaaacttttgctgctgcccgtctgggagcaggtggaaggagcatgcagagaatgtccg

SEQ ID NO: 300801 - DNA, 6100 bp, Homo sapiens
acatgagaggtatgattggtggtggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacacttcctggccaagacacgcagcaccaaggaccagcaattcaagaaggatcagaatgttctctctccagtcaactgctggaatctcctcttaaaccaggtgaagtgggaaagcagggaccataccaccctgagtgacatctacctgaataatatcattcctcgatttgtacaagtcagcgaggactcaggaagactctttaaaaagagtaaagaagtcggccagcagctccaagatgatttgatgaaggtcctgaacgagctctactcggtcatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgtcaagccaagtacacggagaataagctgaaggccatcaaagcccggaatgagtacttgctggctttggaggcaaccaatgcatctgtcttcaagtactacatccatgacctatctgaccttattgatcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacagtaagggagtgctatggcttttaaagagcgtcagcatgcactgcagcactcaagggagatttggaactcagagtccttgttaagtgtctgaaggacaggcattgaatatcttagatacgaatgtgggcatactcagagaccatccctacacttaaaggtgcaaacattaaaagttgtatatgtctaacagggatccgcccaagagaaaggatgctcccaagtatacaactaagaagattttcttttttaagaaatttttaactagctagtaggctttcactggaaagtttccttctcaggcacaggggatcctgaaaggggaacttcatcttttagttcttggagagtacatacaaatattcataataacacatattttgtttataaaaatctataatctcttctaggtgatatgatgacattattttataacttttattgttgggaaactattttttctaattattgctaaaacttaaaggatgggtaatatgcagcattactattttgcacataattccaaaacatcgtattttcttattcatgtatctctagtcttcttttagacagttggacccttttttctttttcttttttttttttttttttaagtattgttaacaatcctttggaagtcactactggtctttgtgtgctgctttttaataattgagttattttgagcttgccaagtaggatctattgcctggactaaaatttatttcctaatcttctgatgaccaagaaaggaaaaattaagtttgcagatgtgagatgaaatatagccagtgaatatgcatactgattctgaatgaaaggaattaacttttcagtcaagaaacagtctgcatgcagtaaattgaatttttcctgcaactggaatgatttgtttaattcttctttgaacactgccctttctccagtaagaacactaatgatttgctaatattttttaaagaaatctgtttttttaattagttaagctcagacttcctcttattttttatcctagagaaaactgctaaaagggaatgatatatcagtactattcttctaaaacaactttttaaaaatgattatacaaagccaaatatgctcattatataaaatttagaagcaaaaagaaggaaataaaaattttccataattctaccagctagagataatggtgttagaatatattcctttctaatctgttttctatgcatgcacaaacacatatgtgagcacatatttataattttattctaaaaaataggacactgctgtacatattgttttacaatctaagtcatataattataatattctttaagcatatttatgagtaaaatattaaaacctatacaaaaaaataatagaatggcattttagctcattcattgatttttataaaatatttaacacactccctggtttgtagttagcgttcaataaatgctaaaaatttatcttcaccatcatcattaatttatttattaatcattattaaattattcattgatcattttttgaggatttactattgccagacactgtgctacaagctgggaatgctgacagtataagataaagagggaaatgatgggggatgggtcatgtaaagggagaactttcatttttacttcatatatatctaagcagttataataggttgatttttgtaatttaaaaaatgtaaaaatgcatacatgcactagtgcatgaatggcagccaggatgagtggaattggagaagcatcacacacacagtgacttttgtgtttgatcttgaagaatgagcgaaccaggcagggagtcggggaggagaatcgcattccttgaggaaagagcagcatgtgggaaaacataaatgcacgcaataacctggctcacatgttaagagaactttctgactataatgagggatgtgttgctgccccaagcttcattatctaaggagtttgttgaacactctctagaggcttttaataataggattgtttagctggtctgtctggactggttagatataacactatttaaatgacccaatctcattacattgtgaagatttccattttttaggttacgtaagaaattttggacctaaaaatcttgcattttaagacagtctttgtcagaattactttttggctctaaatgaattctgtaacatttgtattctaaattgacctttagtaaaagcaggaatggccatattcaaactggtaacctcgcaaatcctgcccaccctttcactttctgtctcaatacattgatgtcctctaacccatttcctgtcttatgtggctttagtgccacttatcaaaattgtgtgcaaatttccttggctaacagtaacagtttttgtctgggcttgtctagcagtggaattctgcctgagttcatcatttttgtgactggtacttgaagtgcatcagatgattaatttcatgataagagggctttttggggtggtgaaatagacatttatggaaaatgggatacccacattaagcagggtgactacctgtttaccatacaacccacacaaagccaatacaactatagatgtgctttctttagtctgttgcctctgcaaacattgcccgtgtgtttctctatgcccttcaaaaacatcagagcagcacatcctggaagatcctatcttttgtaagtttaagaagcagcctcttgtcacaggttgactcctaggtagtgtgcctagtgaccaagagggctgctaagaaagctttctgaccacttgtggctgtcattggactgatttgcccagatgacatcaattgggaatttgaggcatgacctataaagatcagttgcttgcaagagtctcaggaaaataattgtggagttaagaaacttgaagcgatttttaaaaattacctaacccaaccttctcatttgaaaaattaaaaaataaataggccagatatggcggctcatgcctgtaatcccagcgctgtgggagcctgaggcgggtgggtctcttgaggccaggagttcaagaccagcctggacaatgtggtgaaaccctgtctctactaaaaacacaaaaattagctgggtgtggtggcaggcgcctgtaatcccagctactcaggaggctaaggtgggaggattacttgaaccggggaggcataggttgtagtgagccaagatcgtgtcactgcactccagcctgggtgacagagtaagactctgcctaaaaaaaaaaaaagaaagattaaaaaataaataaatctgctgggcgtggtggctcacgcctgtaatcccagcactttgggaggccgaggcgggtggatcacctgaggtcgggagtttgagaccagcctgatcaacatggagaaacctcgtctctactaaaaacacgaaaaaattagctgggcgtggtggcgcatgcctcattcacgtacatgggagagtctacaaagtcacacgtattcataggttaagccacatgctgacaaatgtcataagaagaccctacacttttaccttggccgatccctcccctcagtgcaagctctgtgcaagagtgaacttgaacttcactcagtgcaagagtgaacacacactttgtgccggctttaaagaacccagcacaaagccagtctgcatggcctacagacatattttgctggacaatgattacttgcttttctttttgtttttcttgtatttgcctgtttgattggctcctgacataccagaaaatcactgtcaaaacattagcttaacatttgttaaggaaacaaaaagacttcggtgaccacaccttataaaccaaacagttttgtaaatcactttggaaaatttcactaaaaaaaaaaatccttaacaatataataagtaaagaaaatttaaaaccacaaaacatcactgtgttgtagggggaggtctgatttacagagtaaccacatagtaattataattattagaatgtccagttttcaaaaaacgttacaaggcatacaaagaatgggaaagtgtggctcattcaaaggaacaaaataaaagtgacagaaaatatccctaaagaaacccagacatcaaacttaccagacaaagactttaaaacaactgtcttcattatactcaaatgtcaaaaggaaaacataaacaaagaaataaaggaatcagaaaaaatattaaaaagtaggaatatcagcaaagagataacaaattctggagtggaaaactacaatgataaaaatttaaaaatcaccagagggatttaagagtatatttgcacacacagaggaagccatgaacttgaagagaagaaaatggaaaatactgtctctgagaaacagaaagaataaaaaataaacaatgagcagagactaatgaatttgtgggacatcatcaaatagaccaacattcatattctagaaggataaattatgttgttaaaaagtttaccattctttctttttcacctttcttccttcttccttccccctcctcctttttacttttcttcctcttcctttctcttcttcttttctcttataaccttgggtctcttttccttttctttttcttaattaatctaaaatgtagcgccggtgggaaggatgtccggtctttgatagtcaaagaaacacaaggcacggcgcccatgggggcggctcatgagtgaaagcacggcattctagga

SEQ ID NO: 300802 - DNA, 6065 bp, Homo sapiens
acatgagaggtatgattggtggtggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacacttcctggccaagacacgcagcaccaaggaccagcaattcaagaaggatcagaatgttctctctccagtcaactgctggaatctcctcttaaaccaggtgaagtgggaaagcagggaccataccaccctgagtgacatctacctgaataatatcattcctcgatttgtacaagtcagcgaggactcaggaagactctttaaaaagagtaaagaagtcggccagcagctccaagatgatttgatgaaggtcctgaacgagctctactcgcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgtcaagccaagtacacggagaataagctgaaggccatcaaagcccggaatgagtacttgctggctttggaggcaaccaatgcatctgtcttcaagtactacatccatgacctatctgaccttattgatcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacagtaagggagtgctatggcttttaaagagcgtcagcatgcactgcagcactcaagggagatttggaactcagagtccttgttaagtgtctgaaggacaggcattgaatatcttagatacgaatgtgggcatactcagagaccatccctacacttaaaggtgcaaacattaaaagttgtatatgtctaacagggatccgcccaagagaaaggatgctcccaagtatacaactaagaagattttcttttttaagaaatttttaactagctagtaggctttcactggaaagtttccttctcaggcacaggggatcctgaaaggggaacttcatcttttagttcttggagagtacatacaaatattcataataacacatattttgtttataaaaatctataatctcttctaggtgatatgatgacattattttataacttttattgttgggaaactattttttctaattattgctaaaacttaaaggatgggtaatatgcagcattactattttgcacataattccaaaacatcgtattttcttattcatgtatctctagtcttcttttagacagttggacccttttttctttttcttttttttttttttttttaagtattgttaacaatcctttggaagtcactactggtctttgtgtgctgctttttaataattgagttattttgagcttgccaagtaggatctattgcctggactaaaatttatttcctaatcttctgatgaccaagaaaggaaaaattaagtttgcagatgtgagatgaaatatagccagtgaatatgcatactgattctgaatgaaaggaattaacttttcagtcaagaaacagtctgcatgcagtaaattgaatttttcctgcaactggaatgatttgtttaattcttctttgaacactgccctttctccagtaagaacactaatgatttgctaatattttttaaagaaatctgtttttttaattagttaagctcagacttcctcttattttttatcctagagaaaactgctaaaagggaatgatatatcagtactattcttctaaaacaactttttaaaaatgattatacaaagccaaatatgctcattatataaaatttagaagcaaaaagaaggaaataaaaattttccataattctaccagctagagataatggtgttagaatatattcctttctaatctgttttctatgcatgcacaaacacatatgtgagcacatatttataattttattctaaaaaataggacactgctgtacatattgttttacaatctaagtcatataattataatattctttaagcatatttatgagtaaaatattaaaacctatacaaaaaaataatagaatggcattttagctcattcattgatttttataaaatatttaacacactccctggtttgtagttagcgttcaataaatgctaaaaatttatcttcaccatcatcattaatttatttattaatcattattaaattattcattgatcattttttgaggatttactattgccagacactgtgctacaagctgggaatgctgacagtataagataaagagggaaatgatgggggatgggtcatgtaaagggagaactttcatttttacttcatatatatctaagcagttataataggttgatttttgtaatttaaaaaatgtaaaaatgcatacatgcactagtgcatgaatggcagccaggatgagtggaattggagaagcatcacacacacagtgacttttgtgtttgatcttgaagaatgagcgaaccaggcagggagtcggggaggagaatcgcattccttgaggaaagagcagcatgtgggaaaacataaatgcacgcaataacctggctcacatgttaagagaactttctgactataatgagggatgtgttgctgccccaagcttcattatctaaggagtttgttgaacactctctagaggcttttaataataggattgtttagctggtctgtctggactggttagatataacactatttaaatgacccaatctcattacattgtgaagatttccattttttaggttacgtaagaaattttggacctaaaaatcttgcattttaagacagtctttgtcagaattactttttggctctaaatgaattctgtaacatttgtattctaaattgacctttagtaaaagcaggaatggccatattcaaactggtaacctcgcaaatcctgcccaccctttcactttctgtctcaatacattgatgtcctctaacccatttcctgtcttatgtggctttagtgccacttatcaaaattgtgtgcaaatttccttggctaacagtaacagtttttgtctgggcttgtctagcagtggaattctgcctgagttcatcatttttgtgactggtacttgaagtgcatcagatgattaatttcatgataagagggctttttggggtggtgaaatagacatttatggaaaatgggatacccacattaagcagggtgactacctgtttaccatacaacccacacaaagccaatacaactatagatgtgctttctttagtctgttgcctctgcaaacattgcccgtgtgtttctctatgcccttcaaaaacatcagagcagcacatcctggaagatcctatcttttgtaagtttaagaagcagcctcttgtcacaggttgactcctaggtagtgtgcctagtgaccaagagggctgctaagaaagctttctgaccacttgtggctgtcattggactgatttgcccagatgacatcaattgggaatttgaggcatgacctataaagatcagttgcttgcaagagtctcaggaaaataattgtggagttaagaaacttgaagcgatttttaaaaattacctaacccaaccttctcatttgaaaaattaaaaaataaataggccagatatggcggctcatgcctgtaatcccagcgctgtgggagcctgaggcgggtgggtctcttgaggccaggagttcaagaccagcctggacaatgtggtgaaaccctgtctctactaaaaacacaaaaattagctgggtgtggtggcaggcgcctgtaatcccagctactcaggaggctaaggtgggaggattacttgaaccggggaggcataggttgtagtgagccaagatcgtgtcactgcactccagcctgggtgacagagtaagactctgcctaaaaaaaaaaaaagaaagattaaaaaataaataaatctgctgggcgtggtggctcacgcctgtaatcccagcactttgggaggccgaggcgggtggatcacctgaggtcgggagtttgagaccagcctgatcaacatggagaaacctcgtctctactaaaaacacgaaaaaattagctgggcgtggtggcgcatgcctcattcacgtacatgggagagtctacaaagtcacacgtattcataggttaagccacatgctgacaaatgtcataagaagaccctacacttttaccttggccgatccctcccctcagtgcaagctctgtgcaagagtgaacttgaacttcactcagtgcaagagtgaacacacactttgtgccggctttaaagaacccagcacaaagccagtctgcatggcctacagacatattttgctggacaatgattacttgcttttctttttgtttttcttgtatttgcctgtttgattggctcctgacataccagaaaatcactgtcaaaacattagcttaacatttgttaaggaaacaaaaagacttcggtgaccacaccttataaaccaaacagttttgtaaatcactttggaaaatttcactaaaaaaaaaaatccttaacaatataataagtaaagaaaatttaaaaccacaaaacatcactgtgttgtagggggaggtctgatttacagagtaaccacatagtaattataattattagaatgtccagttttcaaaaaacgttacaaggcatacaaagaatgggaaagtgtggctcattcaaaggaacaaaataaaagtgacagaaaatatccctaaagaaacccagacatcaaacttaccagacaaagactttaaaacaactgtcttcattatactcaaatgtcaaaaggaaaacataaacaaagaaataaaggaatcagaaaaaatattaaaaagtaggaatatcagcaaagagataacaaattctggagtggaaaactacaatgataaaaatttaaaaatcaccagagggatttaagagtatatttgcacacacagaggaagccatgaacttgaagagaagaaaatggaaaatactgtctctgagaaacagaaagaataaaaaataaacaatgagcagagactaatgaatttgtgggacatcatcaaatagaccaacattcatattctagaaggataaattatgttgttaaaaagtttaccattctttctttttcacctttcttccttcttccttccccctcctcctttttacttttcttcctcttcctttctcttcttcttttctcttataaccttgggtctcttttccttttctttttcttaattaatctaaaatgtagcgccggtgggaaggatgtccggtctttgatagtcaaagaaacacaaggcacggcgcccatgggggcggctcatgagtgaaagcacggcattctagga

SEQ ID NO: 300803 - DNA, 5502 bp, Homo sapiens
atcgtgacgtctgtactagagtgtgtctcactgcttctcatacagtactcagtgatgtcgtcaagtcatcgtctcttagtaccttcataccgaaccccatgacttgcgttacatcgagatccattcatgaagatacagccctgttttatttcaccgtaaggaaggtttccaatataatcgacatgcgtcaagccaagtacacggagaataagctgaaggccatcaaagcccggaatgagtacttgctggctttggaggcaaccaatgcatctgtcttcaagtactacatccatgacctatctgaccttattgatcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacagtaagggagtgctatggcttttaaagagcgtcagcatgcactgcagcactcaagggagatttggaactcagagtccttgttaagtgtctgaaggacaggcattgaatatcttagatacgaatgtgggcatactcagagaccatccctacacttaaaggtgcaaacattaaaagttgtatatgtctaacagggatccgcccaagagaaaggatgctcccaagtatacaactaagaagattttcttttttaagaaatttttaactagctagtaggctttcactggaaagtttccttctcaggcacaggggatcctgaaaggggaacttcatcttttagttcttggagagtacatacaaatattcataataacacatattttgtttataaaaatctataatctcttctaggtgatatgatgacattattttataacttttattgttgggaaactattttttctaattattgctaaaacttaaaggatgggtaatatgcagcattactattttgcacataattccaaaacatcgtattttcttattcatgtatctctagtcttcttttagacagttggacccttttttctttttcttttttttttttttttttaagtattgttaacaatcctttggaagtcactactggtctttgtgtgctgctttttaataattgagttattttgagcttgccaagtaggatctattgcctggactaaaatttatttcctaatcttctgatgaccaagaaaggaaaaattaagtttgcagatgtgagatgaaatatagccagtgaatatgcatactgattctgaatgaaaggaattaacttttcagtcaagaaacagtctgcatgcagtaaattgaatttttcctgcaactggaatgatttgtttaattcttctttgaacactgccctttctccagtaagaacactaatgatttgctaatattttttaaagaaatctgtttttttaattagttaagctcagacttcctcttattttttatcctagagaaaactgctaaaagggaatgatatatcagtactattcttctaaaacaactttttaaaaatgattatacaaagccaaatatgctcattatataaaatttagaagcaaaaagaaggaaataaaaattttccataattctaccagctagagataatggtgttagaatatattcctttctaatctgttttctatgcatgcacaaacacatatgtgagcacatatttataattttattctaaaaaataggacactgctgtacatattgttttacaatctaagtcatataattataatattctttaagcatatttatgagtaaaatattaaaacctatacaaaaaaataatagaatggcattttagctcattcattgatttttataaaatatttaacacactccctggtttgtagttagcgttcaataaatgctaaaaatttatcttcaccatcatcattaatttatttattaatcattattaaattattcattgatcattttttgaggatttactattgccagacactgtgctacaagctgggaatgctgacagtataagataaagagggaaatgatgggggatgggtcatgtaaagggagaactttcatttttacttcatatatatctaagcagttataataggttgatttttgtaatttaaaaaatgtaaaaatgcatacatgcactagtgcatgaatggcagccaggatgagtggaattggagaagcatcacacacacagtgacttttgtgtttgatcttgaagaatgagcgaaccaggcagggagtcggggaggagaatcgcattccttgaggaaagagcagcatgtgggaaaacataaatgcacgcaataacctggctcacatgttaagagaactttctgactataatgagggatgtgttgctgccccaagcttcattatctaaggagtttgttgaacactctctagaggcttttaataataggattgtttagctggtctgtctggactggttagatataacactatttaaatgacccaatctcattacattgtgaagatttccattttttaggttacgtaagaaattttggacctaaaaatcttgcattttaagacagtctttgtcagaattactttttggctctaaatgaattctgtaacatttgtattctaaattgacctttagtaaaagcaggaatggccatattcaaactggtaacctcgcaaatcctgcccaccctttcactttctgtctcaatacattgatgtcctctaacccatttcctgtcttatgtggctttagtgccacttatcaaaattgtgtgcaaatttccttggctaacagtaacagtttttgtctgggcttgtctagcagtggaattctgcctgagttcatcatttttgtgactggtacttgaagtgcatcagatgattaatttcatgataagagggctttttggggtggtgaaatagacatttatggaaaatgggatacccacattaagcagggtgactacctgtttaccatacaacccacacaaagccaatacaactatagatgtgctttctttagtctgttgcctctgcaaacattgcccgtgtgtttctctatgcccttcaaaaacatcagagcagcacatcctggaagatcctatcttttgtaagtttaagaagcagcctcttgtcacaggttgactcctaggtagtgtgcctagtgaccaagagggctgctaagaaagctttctgaccacttgtggctgtcattggactgatttgcccagatgacatcaattgggaatttgaggcatgacctataaagatcagttgcttgcaagagtctcaggaaaataattgtggagttaagaaacttgaagcgatttttaaaaattacctaacccaaccttctcatttgaaaaattaaaaaataaataggccagatatggcggctcatgcctgtaatcccagcgctgtgggagcctgaggcgggtgggtctcttgaggccaggagttcaagaccagcctggacaatgtggtgaaaccctgtctctactaaaaacacaaaaattagctgggtgtggtggcaggcgcctgtaatcccagctactcaggaggctaaggtgggaggattacttgaaccggggaggcataggttgtagtgagccaagatcgtgtcactgcactccagcctgggtgacagagtaagactctgcctaaaaaaaaaaaaagaaagattaaaaaataaataaatctgctgggcgtggtggctcacgcctgtaatcccagcactttgggaggccgaggcgggtggatcacctgaggtcgggagtttgagaccagcctgatcaacatggagaaacctcgtctctactaaaaacacgaaaaaattagctgggcgtggtggcgcatgcctcattcacgtacatgggagagtctacaaagtcacacgtattcataggttaagccacatgctgacaaatgtcataagaagaccctacacttttaccttggccgatccctcccctcagtgcaagctctgtgcaagagtgaacttgaacttcactcagtgcaagagtgaacacacactttgtgccggctttaaagaacccagcacaaagccagtctgcatggcctacagacatattttgctggacaatgattacttgcttttctttttgtttttcttgtatttgcctgtttgattggctcctgacataccagaaaatcactgtcaaaacattagcttaacatttgttaaggaaacaaaaagacttcggtgaccacaccttataaaccaaacagttttgtaaatcactttggaaaatttcactaaaaaaaaaaatccttaacaatataataagtaaagaaaatttaaaaccacaaaacatcactgtgttgtagggggaggtctgatttacagagtaaccacatagtaattataattattagaatgtccagttttcaaaaaacgttacaaggcatacaaagaatgggaaagtgtggctcattcaaaggaacaaaataaaagtgacagaaaatatccctaaagaaacccagacatcaaacttaccagacaaagactttaaaacaactgtcttcattatactcaaatgtcaaaaggaaaacataaacaaagaaataaaggaatcagaaaaaatattaaaaagtaggaatatcagcaaagagataacaaattctggagtggaaaactacaatgataaaaatttaaaaatcaccagagggatttaagagtatatttgcacacacagaggaagccatgaacttgaagagaagaaaatggaaaatactgtctctgagaaacagaaagaataaaaaataaacaatgagcagagactaatgaatttgtgggacatcatcaaatagaccaacattcatattctagaaggataaattatgttgttaaaaagtttaccattctttctttttcacctttcttccttcttccttccccctcctcctttttacttttcttcctcttcctttctcttcttcttttctcttataaccttgggtctcttttccttttctttttcttaattaatctaaaatgtagcgccggtgggaaggatgtccggtctttgatagtcaaagaaacacaaggcacggcgcccatgggggcggctcatgagtgaaagcacggcattctagga

SEQ ID NO: 300804 - DNA, 5272 bp, Homo sapiens
agcattgtgtttctggagccggagctgcctgaggcactcttctccagcctcctcagccttccatggagctgcagaccctacatagacctacccctgccaggctccaaacagatccccctacccattcctttcatgtactgtttggtcctggaagaggctcacacaagttggctttgggttttgcttcaacatagaaaccacgagccttataccttgaatatgggtagtttcattgccagtaatgggaactctggaactgccaaagggactgtatcctctttctgacctggtgttgctttcttttgttaggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacagtaagggagtgctatggcttttaaagagcgtcagcatgcactgcagcactcaagggagatttggaactcagagtccttgttaagtgtctgaaggacaggcattgaatatcttagatacgaatgtgggcatactcagagaccatccctacacttaaaggtgcaaacattaaaagttgtatatgtctaacagggatccgcccaagagaaaggatgctcccaagtatacaactaagaagattttcttttttaagaaatttttaactagctagtaggctttcactggaaagtttccttctcaggcacaggggatcctgaaaggggaacttcatcttttagttcttggagagtacatacaaatattcataataacacatattttgtttataaaaatctataatctcttctaggtgatatgatgacattattttataacttttattgttgggaaactattttttctaattattgctaaaacttaaaggatgggtaatatgcagcattactattttgcacataattccaaaacatcgtattttcttattcatgtatctctagtcttcttttagacagttggacccttttttctttttcttttttttttttttttttaagtattgttaacaatcctttggaagtcactactggtctttgtgtgctgctttttaataattgagttattttgagcttgccaagtaggatctattgcctggactaaaatttatttcctaatcttctgatgaccaagaaaggaaaaattaagtttgcagatgtgagatgaaatatagccagtgaatatgcatactgattctgaatgaaaggaattaacttttcagtcaagaaacagtctgcatgcagtaaattgaatttttcctgcaactggaatgatttgtttaattcttctttgaacactgccctttctccagtaagaacactaatgatttgctaatattttttaaagaaatctgtttttttaattagttaagctcagacttcctcttattttttatcctagagaaaactgctaaaagggaatgatatatcagtactattcttctaaaacaactttttaaaaatgattatacaaagccaaatatgctcattatataaaatttagaagcaaaaagaaggaaataaaaattttccataattctaccagctagagataatggtgttagaatatattcctttctaatctgttttctatgcatgcacaaacacatatgtgagcacatatttataattttattctaaaaaataggacactgctgtacatattgttttacaatctaagtcatataattataatattctttaagcatatttatgagtaaaatattaaaacctatacaaaaaaataatagaatggcattttagctcattcattgatttttataaaatatttaacacactccctggtttgtagttagcgttcaataaatgctaaaaatttatcttcaccatcatcattaatttatttattaatcattattaaattattcattgatcattttttgaggatttactattgccagacactgtgctacaagctgggaatgctgacagtataagataaagagggaaatgatgggggatgggtcatgtaaagggagaactttcatttttacttcatatatatctaagcagttataataggttgatttttgtaatttaaaaaatgtaaaaatgcatacatgcactagtgcatgaatggcagccaggatgagtggaattggagaagcatcacacacacagtgacttttgtgtttgatcttgaagaatgagcgaaccaggcagggagtcggggaggagaatcgcattccttgaggaaagagcagcatgtgggaaaacataaatgcacgcaataacctggctcacatgttaagagaactttctgactataatgagggatgtgttgctgccccaagcttcattatctaaggagtttgttgaacactctctagaggcttttaataataggattgtttagctggtctgtctggactggttagatataacactatttaaatgacccaatctcattacattgtgaagatttccattttttaggttacgtaagaaattttggacctaaaaatcttgcattttaagacagtctttgtcagaattactttttggctctaaatgaattctgtaacatttgtattctaaattgacctttagtaaaagcaggaatggccatattcaaactggtaacctcgcaaatcctgcccaccctttcactttctgtctcaatacattgatgtcctctaacccatttcctgtcttatgtggctttagtgccacttatcaaaattgtgtgcaaatttccttggctaacagtaacagtttttgtctgggcttgtctagcagtggaattctgcctgagttcatcatttttgtgactggtacttgaagtgcatcagatgattaatttcatgataagagggctttttggggtggtgaaatagacatttatggaaaatgggatacccacattaagcagggtgactacctgtttaccatacaacccacacaaagccaatacaactatagatgtgctttctttagtctgttgcctctgcaaacattgcccgtgtgtttctctatgcccttcaaaaacatcagagcagcacatcctggaagatcctatcttttgtaagtttaagaagcagcctcttgtcacaggttgactcctaggtagtgtgcctagtgaccaagagggctgctaagaaagctttctgaccacttgtggctgtcattggactgatttgcccagatgacatcaattgggaatttgaggcatgacctataaagatcagttgcttgcaagagtctcaggaaaataattgtggagttaagaaacttgaagcgatttttaaaaattacctaacccaaccttctcatttgaaaaattaaaaaataaataggccagatatggcggctcatgcctgtaatcccagcgctgtgggagcctgaggcgggtgggtctcttgaggccaggagttcaagaccagcctggacaatgtggtgaaaccctgtctctactaaaaacacaaaaattagctgggtgtggtggcaggcgcctgtaatcccagctactcaggaggctaaggtgggaggattacttgaaccggggaggcataggttgtagtgagccaagatcgtgtcactgcactccagcctgggtgacagagtaagactctgcctaaaaaaaaaaaaagaaagattaaaaaataaataaatctgctgggcgtggtggctcacgcctgtaatcccagcactttgggaggccgaggcgggtggatcacctgaggtcgggagtttgagaccagcctgatcaacatggagaaacctcgtctctactaaaaacacgaaaaaattagctgggcgtggtggcgcatgcctcattcacgtacatgggagagtctacaaagtcacacgtattcataggttaagccacatgctgacaaatgtcataagaagaccctacacttttaccttggccgatccctcccctcagtgcaagctctgtgcaagagtgaacttgaacttcactcagtgcaagagtgaacacacactttgtgccggctttaaagaacccagcacaaagccagtctgcatggcctacagacatattttgctggacaatgattacttgcttttctttttgtttttcttgtatttgcctgtttgattggctcctgacataccagaaaatcactgtcaaaacattagcttaacatttgttaaggaaacaaaaagacttcggtgaccacaccttataaaccaaacagttttgtaaatcactttggaaaatttcactaaaaaaaaaaatccttaacaatataataagtaaagaaaatttaaaaccacaaaacatcactgtgttgtagggggaggtctgatttacagagtaaccacatagtaattataattattagaatgtccagttttcaaaaaacgttacaaggcatacaaagaatgggaaagtgtggctcattcaaaggaacaaaataaaagtgacagaaaatatccctaaagaaacccagacatcaaacttaccagacaaagactttaaaacaactgtcttcattatactcaaatgtcaaaaggaaaacataaacaaagaaataaaggaatcagaaaaaatattaaaaagtaggaatatcagcaaagagataacaaattctggagtggaaaactacaatgataaaaatttaaaaatcaccagagggatttaagagtatatttgcacacacagaggaagccatgaacttgaagagaagaaaatggaaaatactgtctctgagaaacagaaagaataaaaaataaacaatgagcagagactaatgaatttgtgggacatcatcaaatagaccaacattcatattctagaaggataaattatgttgttaaaaagtttaccattctttctttttcacctttcttccttcttccttccccctcctcctttttacttttcttcctcttcctttctcttcttcttttctcttataaccttgggtctcttttccttttctttttcttaattaatctaaaatgtagcgccggtgggaaggatgtccggtctttgatagtcaaagaaacacaaggcacggcgcccatgggggcggctcatgagtgaaagcacggcattctagga

SEQ ID NO: 300805 - DNA, 5989 bp, Homo sapiens
acatgagaggtatgattggtggtggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacacttcctggccaagacacgcagcaccaaggaccagcaattcaagaaggatcagaatgttctctctccagtcaactgctggaatctcctcttaaaccaggtgaagtgggaaagcagggaccataccaccctgagtgacatctacctgaataatatcattcctcgatttgtacaagtcagcgaggactcaggaagactctttaaaaagagtaaagaagtcggccagcagctccaagatgatttgatgaaggtcctgaacgagctctactcggtcatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgtcaagccaagtacacggagaataagctgaaggccatcaaagcccggaatgagtacttgctggctttggaggcaaccaatgcatctgtcttcaagtactacatccatgacctatctgaccttattgatcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacagtaagggagtgctatggcttttaaagagcgtcagcatgcactgcagcactcaagggagatttggaactcagagtccttgttaagtgtctgaaggacaggcattgaatatcttagatacgaatgtgggcatactcagagaccatccctacacttaaaggtgcaaacattaaaagttgtatatgtctaacagggatccgcccaagagaaaggatgctcccaagtatacaactaagaagattttcttttttaagaaatttttaactagctagtaggctttcactggaaagtttccttctcaggcacaggggatcctgaaaggggaacttcatcttttagttcttggagagtacatacaaatattcataataacacatattttgtttataaaaatctataatctcttctaggtgatatgatgacattattttataacttttattgttgggaaactattttttctaattattgctaaaacttaaaggatgggtaatatgcagcattactattttgcacataattccaaaacatcgtattttcttattcatgtatctctagtcttcttttagacagttggacccttttttctttttcttttttttttttttttttaagtattgttaacaatcctttggaagtcactactggtctttgtgtgctgctttttaataattgagttattttgagcttgccaagtaggatctattgcctggactaaaatttatttcctaatcttctgatgaccaagaaaggaaaaattaagtttgcagatgtgagatgaaatatagccagtgaatatgcatactgattctgaatgaaaggaattaacttttcagtcaagaaacagtctgcatgcagtaaattgaatttttcctgcaactggaatgatttgtttaattcttctttgaacactgccctttctccagtaagaacactaatgatttgctaatattttttaaagaaatctgtttttttaattagttaagctcagacttcctcttattttttatcctagagaaaactgctaaaagggaatgatatatcagtactattcttctaaaacaactttttaaaaatgattatacaaagccaaatatgctcattatataaaatttagaagcaaaaagaaggaaataaaaattttccataattctaccagctagagataatggtgttagaatatattcctttctaatctgttttctatgcatgcacaaacacatatgtgagcacatatttataattttattctaaaaaataggacactgctgtacatattgttttacaatctaagtcatataattataatattctttaagcatatttatgagtaaaatattaaaacctatacaaaaaaataatagaatggcattttagctcattcattgatttttataaaatatttaacacactccctggtttgtagttagcgttcaataaatgctaaaaatttatcttcaccatcatcattaatttatttattaatcattattaaattattcattgatcattttttgaggatttactattgccagacactgtgctacaagctgggaatgctgacagtataagataaagagggaaatgatgggggatgggtcatgtaaagggagaactttcatttttacttcatatatatctaagcagttataataggttgatttttgtaatttaaaaaatgtaaaaatgcatacatgcactagtgcatgaatggcagccaggatgagtggaattggagaagcatcacacacacagtgacttttgtgtttgatcttgaagaatgagcgaaccaggcagggagtcggggaggagaatcgcattccttgaggaaagagcagcatgtgggaaaacataaatgcacgcaataacctggctcacatgttaagagaactttctgactataatgagggatgtgttgctgccccaagcttcattatctaaggagtttgttgaacactctctagaggcttttaataataggattgtttagctggtctgtctggactggttagatataacactatttaaatgacccaatctcattacattgtgaagatttccattttttaggttacgtaagaaattttggacctaaaaatcttgcattttaagacagtctttgtcagaattactttttggctctaaatgaattctgtaacatttgtattctaaattgacctttagtaaaagcaggaatggccatattcaaactggtaacctcgcaaatcctgcccaccctttcactttctgtctcaatacattgatgtcctctaacccatttcctgtcttatgtggctttagtgccacttatcaaaattgtgtgcaaatttccttggctaacagtaacagtttttgtctgggcttgtctagcagtggaattctgcctgagttcatcatttttgtgactggtacttgaagtgcatcagatgattaatttcatgatagatgtgctttctttagtctgttgcctctgcaaacattgcccgtgtgtttctctatgcccttcaaaaacatcagagcagcacatcctggaagatcctatcttttgtaagtttaagaagcagcctcttgtcacaggttgactcctaggtagtgtgcctagtgaccaagagggctgctaagaaagctttctgaccacttgtggctgtcattggactgatttgcccagatgacatcaattgggaatttgaggcatgacctataaagatcagttgcttgcaagagtctcaggaaaataattgtggagttaagaaacttgaagcgatttttaaaaattacctaacccaaccttctcatttgaaaaattaaaaaataaataggccagatatggcggctcatgcctgtaatcccagcgctgtgggagcctgaggcgggtgggtctcttgaggccaggagttcaagaccagcctggacaatgtggtgaaaccctgtctctactaaaaacacaaaaattagctgggtgtggtggcaggcgcctgtaatcccagctactcaggaggctaaggtgggaggattacttgaaccggggaggcataggttgtagtgagccaagatcgtgtcactgcactccagcctgggtgacagagtaagactctgcctaaaaaaaaaaaaagaaagattaaaaaataaataaatctgctgggcgtggtggctcacgcctgtaatcccagcactttgggaggccgaggcgggtggatcacctgaggtcgggagtttgagaccagcctgatcaacatggagaaacctcgtctctactaaaaacacgaaaaaattagctgggcgtggtggcgcatgcctcattcacgtacatgggagagtctacaaagtcacacgtattcataggttaagccacatgctgacaaatgtcataagaagaccctacacttttaccttggccgatccctcccctcagtgcaagctctgtgcaagagtgaacttgaacttcactcagtgcaagagtgaacacacactttgtgccggctttaaagaacccagcacaaagccagtctgcatggcctacagacatattttgctggacaatgattacttgcttttctttttgtttttcttgtatttgcctgtttgattggctcctgacataccagaaaatcactgtcaaaacattagcttaacatttgttaaggaaacaaaaagacttcggtgaccacaccttataaaccaaacagttttgtaaatcactttggaaaatttcactaaaaaaaaaaatccttaacaatataataagtaaagaaaatttaaaaccacaaaacatcactgtgttgtagggggaggtctgatttacagagtaaccacatagtaattataattattagaatgtccagttttcaaaaaacgttacaaggcatacaaagaatgggaaagtgtggctcattcaaaggaacaaaataaaagtgacagaaaatatccctaaagaaacccagacatcaaacttaccagacaaagactttaaaacaactgtcttcattatactcaaatgtcaaaaggaaaacataaacaaagaaataaaggaatcagaaaaaatattaaaaagtaggaatatcagcaaagagataacaaattctggagtggaaaactacaatgataaaaatttaaaaatcaccagagggatttaagagtatatttgcacacacagaggaagccatgaacttgaagagaagaaaatggaaaatactgtctctgagaaacagaaagaataaaaaataaacaatgagcagagactaatgaatttgtgggacatcatcaaatagaccaacattcatattctagaaggataaattatgttgttaaaaagtttaccattctttctttttcacctttcttccttcttccttccccctcctcctttttacttttcttcctcttcctttctcttcttcttttctcttataaccttgggtctcttttccttttctttttcttaattaatctaaaatgtagcgccggtgggaaggatgtccggtctttgatagtcaaagaaacacaaggcacggcgcccatgggggcggctcatgagtgaaagcacggcattctagga

SEQ ID NO: 300806 - DNA, 4182 bp, Homo sapiens
acatgagaggtatgattggtggtggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacacttcctggccaagacacgcagcaccaaggaccagcaattcaagaaggatcagaatgttctctctccagtcaactgctggaatctcctcttaaaccaggtgaagtgggaaagcagggaccataccaccctgagtgacatctacctgaataatatcattcctcgatttgtacaagtcagcgaggactcaggaagactctttaaaaagagtaaagaagtcggccagcagctccaagatgatttgatgaaggtcctgaacgagctctactcggtcatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgtcaagccaagtacacggagaataagctgaaggccatcaaagcccggaatgagtacttgctggctttggaggcaaccaatgcatctgtcttcaagtactacatccatgacctatctgaccttattgatcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacaaaaatgaaagagtacctggagggcaggaacctcatcaccaagttacaagccaagcatgaccttctgcagaaaaccctgggagaaagtcagcggacagattgcagtctagccaggcgcagctcaactgtgaggaaacaggactccagccaggcaattcctctggtggtggaaagctgtatccggtttatcagcagacacggactacagcatgaaggaattttccgggtgtcaggatcccaggtggaagtgaatgacatcaaaaatgcctttgagagaggagaggaccccctggctggggaccagaacgaccatgacatggattccatagctggtgtcctgaagctttacttccgggggctggaacaccctctcttccccaaggacatctttcatgacctgatggcctgcgtcacaatggacaacctgcaggagagagctctgcacatccggaaagtcctcctagtcctgcccaaaaccactctgattatcatgagatacctctttgccttcctcaatcatttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactgtgatagccctcatggagagactacctcggttgaagactcaacccaggatgtgaccgcagagcaccacacgagcgatgacgaatgtgagcccatcgaggccattgccaagtttgactacgtgggccggacagcccgagagctgtcctttaagaagggagcatccctgctgctttaccagcgggcttccgacgactggtgggaaggccggcacaatggcatcgacggactcatcccccatcagtacatcgtggtccaagacaccgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaagtaagctctgcttttcattttctgctcccctgaatgacttgcaacacccagcctcaccctctggcctaacccccatctccattcctgtgctgcacgtagggctcccagctcccccagcctaacagtttgcatgtggtcattgctgctgcaaggcggacagggctgaggatgctgctacaagcctcggggcaggtccaggtctccagctagctgccctcgtgctgtggaagggtgctttactgtgtgttcccgcagtgtctgtccacccagacctttgtggcagtcttacagctaaaactttgaccaaagctttggtcactttatgcaacctggttttgtactgtttctcagaggtgccttcttttttccaatccatactcaaataatagtctttgatgtctgtcttccttgacccgtgttcgtgcaaagattcagagtctgtgtgtggcttctactaggctgatgttacaccaggtgggtttattgagatatcatgtgtctgttcctccccctgtcctgcattcactcctgtggaggaaaggaggccacgatgtccctaaggaaagctttgtcctgagctcttcattcattggctaacccctagctcccttttcttctgccctttcacaccaggagaaataattttccattttgttcctattgctttggccttttgtattattctacccccttagtccctttgcagatccccactcctgctcagcaggctcttacctctgacccccagctttcattgtggctgttagcaacatcctggggtttaaactccacccacgcccgatctggctgtctagagggattctacgcctgcgtgctgccgcctccccaagaggcattcaggttattggagaactaatctcatctcaaggggccagacaccaagtcccaaagcctacagacctctttccgccaggccctgaaacctggccccgtgccagcaggatgacaagccccagggcgctcctgatgaatatggattggagatgatgtacagtttttattcccctctggcttttgaggaatgaaatgatttgcactttgaaaacctgttaaccgtagcctctggacactgagactggaaggagaataaaggatgcttgttgtttttaaactataccaggtttcccagatctcttggcttttttccacccagacggtagcagggggagtggttggggcacgtggctcttttccatctctttcaccctcaagttagtaaagtcgtttattcagatcacttactcagtgtagttataatttaattcagaccagttaaaaaaaaattgagaagtttctgtttccctccagcacactgccctgctgggaggcaagccaatatcaagtaactgtgggctaatcacatttttttccttatttacaattctgtgttaaattgtaaccctacaatcaaaaggtcgtgatcctataattaactcagaaaccaaggcggggttggtggaggaagagttagataattagttaagtacatatttttaagccatcatatatttgatgccatttgtgcatagaaattgtagagagtaataactgaaatggtaaacagaagaagaaa

SEQ ID NO: 300807 - DNA, 7054 bp, Homo sapiens
acatgagaggtatgattggtggtggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacacttcctggccaagacacgcagcaccaaggaccagcaattcaagaaggatcagaatgttctctctccagtcaactgctggaatctcctcttaaaccaggtgaagtgggaaagcagggaccataccaccctgagtgacatctacctgaataatatcattcctcgatttgtacaagtcagcgaggactcaggaagactctttaaaaagagtaaagaagtcggccagcagctccaagatgatttgatgaaggtcctgaacgagctctactcggtcatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgtcaagccaagtacacggagaataagctgaaggccatcaaagcccggaatgagtacttgctggctttggaggcaaccaatgcatctgtcttcaagtactacatccatgacctatctgaccttattgatcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacaaaaatgaaagagtacctggagggcaggaacctcatcaccaagttacaagccaagcatgaccttctgcagaaaaccctgggagaaagtcagcggacagattgcagtctagccaggcgcagctcaactgtgaggaaacaggactccagccaggcaattcctctggtggtggaaagctgtatccggtttatcagcagacacggactacagcatgaaggaattttccgggtgtcaggatcccaggtggaagtgaatgacatcaaaaatgcctttgagagaggagaggaccccctggctggggaccagaacgaccatgacatggattccatagctggtgtcctgaagctttacttccgggggctggaacaccctctcttccccaaggacatctttcatgacctgatggcctgcgtcacaatggacaacctgcaggagagagctctgcacatccggaaagtcctcctagtcctgcccaaaaccactctgattatcatgagatacctctttgccttcctcaatcatttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactgtgatagccctcatggagagactacctcggttgaagactcaacccaggatgtgaccgcagagcaccacacgagcgatgacgaatgtgagcccatcgaggccattgccaagtttgactacgtgggccggacagcccgagagctgtcctttaagaagggagcatccctgctgctttaccagcgggcttccgacgactggtgggaaggccggcacaatggcatcgacggactcatcccccatcagtacatcgtggtccaagacacgttgatatcctgagtgagtctgcaccctcccagcctcttcccggctcgttctgcagggaaatcctccctctgttgatagcatcgcaaacctggtggcaatctgtgcgtggacaggaccctcccaaatttagcattatgacttcaccacaggatcaagagaagatgaattgtgggggagaaggggctttctttgtcatcagtagccagaggggccaggagagcagtggagagacctgggaccggcttggatgctctgagcggggctagaggcgctacgacagtgtgtggcggtgtcctgccacgacgccgccgtctccagagccaccacacagttgactgtccttacccggcagtgctcaggacctcagccgataaaccacaacctggacttgccgcctccttctccaggaggccgccccagcacggcctccccaggaagcagcatggggtagaaggcagatgcctcgaatccaggtgtcccctagccacgctttcctgaggagctgaggagcccgcagaactcagcggattatttatttttatttaaacgacccttcaaaggcccttaggtttccttgcctctgctcacagaactagtccagccaggtgtcgctgctgcctcagagctgtgtggggtcgcgtgtatgtcggggggccatcttgccgatttaacgctgctttttgtgttgttgttgttttccctcctccctgcctgcctgccccttctcccccagcgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaagcaaaggaagcgtccagaatctgggagcatccggaaaacttttcggagtgacagccatgggctgagcagttccctgactgactcctcctccccaggggtgggggctagctgccgcccatcctcccagcccatcatgagccagagcctccccaaagaagggccagataagtgttccatcagtgggcacgggagcctcaactccatcagccgccactcatccctgaagaatcggctggatagtccacagatccggaagactgccacagcgggaaggtcaaaaagcttcaataaccatcggcccatggaccctgaggtcattgctcaggatattgaggcaacaatgaactcggccctgaatgagctacgggaactagaacggcagagcagtgtcaaacacacccctgacgtggttctggacaccttggagcccctcaaaacctccccagtggtggcccccacgtcagagccctccagccctctgcacacccagctcctcaaggaccccgagcccgccttccagcgcagcgccagtactgctggggacatcgcctgcgccttccggcctgtcaagtctgtcaagatggctgccccggtcaaaccaccagccacacggcccaagcccactgtcttccccaaaacaaatgccactagccctggtgtcaactcatcaacttccccacagtctactgacaagtcttgtactgtctgagggataataatttaattgttctagacaaggggactatagggactgactgttattaaaatcttcctatttaactagcttggggacttcagttgaaaattaggttctaagttgttcttgcaggaattagcctccccgtctcccaaaaccttgagaatgaagcccttggtatcgcctctcccttcccactgccctctgcttcccccagtcgtcgtaattcagccagctgcagtccgtaccgttcttaggttagccagagacaggttttcattatcaggtcactgtgaaatctggtaaggcagtcctgaggacatgggctcaagtctcagtcccctcagaccacggtgatgccttgaccagatggttggctactgccatccagctttcagtggcatcttgttttgggaactgattatagagaatcatatatagtccagtcttcattttacatacacacacatattttacacacacacacattttacacacacacacacacacacacacacatatgtttttctagtctctggcatgtgtagcctctcctggtcatagaccagtctctttgtaagttattgtggcagttcacacagtagccaccaggggtctctgtttccatcacaaactttgttctgtctgggccagagaacctagcctttgaaatctctccatcatatgaaacataacgggatgggacaatcccgtaacctgtttggggttgggggctttctctctgtgttctttccattgatgtgaattggtcattggtgtttgctcttgcctctcctccatcccctagaagtacacccccgtcttattaaggagcttttaaagtttttctgaatgtatagacatttctcgggttcctacctttgtctctgatggaccattttccatttaagacattttcctgtataagacagttttatagctggttccttttagggtaaagagtcttaagagagttttattgtgtctatggcaggtttgggaaaggtaagaaatgggtcctttttcctcctaatgtttttggcacttaaaacataaaattcattatcctattaaaaaattaaattcagctttgctaatccagaaattgttcccaaatgaaaacttgttttaagtccaccccttagtttccttattttacaaggtctctcttcagggaccaacaggggcttagagagccttagttagattaaagggagaccctacctcttaaaaccagttttcatttatgcaaacaaggacaattaagggaaccctgaccccacaggctctcaagtcttcccaaggccagaatcgaaagaaaattaaaatttgaatgctgaatattctggctctactctggccttttttctggttcccttccaaaatgcacaaatcatacccttgtctgctccaattcagtctccaaacctggtgcctgtgctcctggcccccctagcatcatgctatcccaggagtatcaggaccagacacatccacagccaggctcatgggtctcagacagcaacttgagttaaagctgaaactcatccttcttctctgtgttttctggtttaaaagctgcacttatattttagccttattattttctgtagttccggagagatggtgggttgccattctggtaggaaaatctgagttttcttatctttgacctagaagagattctttttggaccaacctgcgaaattggtagttaggtctatggaaagtggtaggatttttttttttttaatcctgtgcaaaggaaaagaggtgctttgtgggaaatcactaatgagaaggctaacctgcagcaccagagaaacctttccaagtgctaggcaggagaactgaagaactctttcagtgaagtgagtcagcctagaagaggcaacccacagtcttgatttttgttgctgtttcctgacctgttcttgcctgtcacctgggcctacacaggtcccgagccaacggggctttcatacccaaggatctgtttccttgctgaaaatgaaaccctatctttcactttacattcctttcaatccaactgatcaaaactggtacccacacttgccctttctccctctctccagcacactcccctctaagaaagtaaaagcaaagctttcttaatggcaacactttgggcctgttctgttgctcctgccttatttctctttcaaccctgtacatgactcgtgttcaccatccccttgatcagtgtccatccgcgctaatttgcatcatgaactgaacagtgtgtgagtggtcacctactaaacccagctctgggggcagagctgtcttccccatctctggtgctcctaacacctgtgagatggtcctgtcgagaggactaggaaccgataggaggagagtccttctcggcagagctcactgcaaacaactggaattgaggttgcacactgtgatttttacaccgaaaagccaaaaggagctggccatccagggcctagggagaccagccttcctcagctatgcttgccgaaaccagcatgatgcttcaaagagccctgctccacccctcatggcatggatccttttcctggtgtggactctgaagggtcagtcttcggggaagagaggtggggtggggctactagcatcccaatttagaaaacagaggagtttgtagccagcagcctgtaaactggaaacactggtctcagccaacctcctcagggcgccctggcttctccccaaggagatgaggagcggtgatgccagcaccgggatgcgcagagcactggaagggctggtgcagatctacttcccatgcagaagagaagtcacatcttccagggaatcgcaatgttgtggcgtctgacttgtatgtcacatttgtgtaaaatggtatattctttaaaatagtgttgataactggaatattgtatgtatgcttggagatgctttgtgtgaacctaagactgtcactcaacagatgttggattggggaaaatccaaagcacaacttcaaaataaaatacatttttaggtttcaaaaaaaaaaa

SEQ ID NO: 300808 - DNA, 4916 bp, Homo sapiens
acatgagaggtatgattggtggtggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacacttcctggccaagacacgcagcaccaaggaccagcaattcaagaaggatcagaatgttctctctccagtcaactgctggaatctcctcttaaaccaggtgaagtgggaaagcagggaccataccaccctgagtgacatctacctgaataatatcattcctcgatttgtacaagtcagcgaggactcaggaagactctttaaaaagagtaaagaagtcggccagcagctccaagatgatttgatgaaggtcctgaacgagctctactcggtcatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgtcaagccaagtacacggagaataagctgaaggccatcaaagcccggaatgagtacttgctggctttggaggcaaccaatgcatctgtcttcaagtactacatccatgacctatctgaccttattgatcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacaaaaatgaaagagtacctggagggcaggaacctcatcaccaagttacaagccaagcatgaccttctgcagaaaaccctgggagaaagtcagcggacagattgcagtctagccaggcgcagctcaactgtgaggaaacaggactccagccaggcaattcctctggtggtggaaagctgtatccggtttatcagcagacacggactacagcatgaaggaattttccgggtgtcaggatcccaggtggaagtgaatgacatcaaaaatgcctttgagagaggagaggaccccctggctggggaccagaacgaccatgacatggattccatagctggtgtcctgaagctttacttccgggggctggaacaccctctcttccccaaggacatctttcatgacctgatggcctgcgtcacaatggacaacctgcaggagagagctctgcacatccggaaagtcctcctagtcctgcccaaaaccactctgattatcatgagatacctctttgccttcctcaatcatttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactgtgatagccctcatggagagactacctcggttgaagactcaacccaggatgtgaccgcagagcaccacacgagcgatgacgaatgtgagcccatcgaggccattgccaagtttgactacgtgggccggacagcccgagagctgtcctttaagaagggagcatccctgctgctttaccagcgggcttccgacgactggtgggaaggccggcacaatggcatcgacggactcatcccccatcagtacatcgtggtccaagacacgttgatatcctgagtgagtctgcaccctcccagcctcttcccggctcgttctgcagggaaatcctccctctgttgatagcatcgcaaacctggtggcaatctgtgcgtggacaggaccctcccaaatttagcattatgacttcaccacaggatcaagagaagatgaattgtgggggagaaggggctttctttgtcatcagtagccagaggggccaggagagcagtggagagacctgggaccggcttggatgctctgagcggggctagaggcgctacgacagtgtgtggcggtgtcctgccacgacgccgccgtctccagagccaccacacagttgactgtccttacccggcagtgctcaggacctcagccgataaaccacaacctggacttgccgcctccttctccaggaggccgccccagcacggcctccccaggaagcagcatggggtagaaggcagatgcctcgaatccaggtgtcccctagccacgctttcctgaggagctgaggagcccgcagaactcagcggattatttatttttatttaaacgacccttcaaaggcccttaggtttccttgcctctgctcacagaactagtccagccaggtgtcgctgctgcctcagagctgtgtggggtcgcgtgtatgtcggggggccatcttgccgatttaacgctgctttttgtgttgttgttgttttccctcctccctgcctgcctgccccttctcccccagcgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaagtaagctctgcttttcattttctgctcccctgaatgacttgcaacacccagcctcaccctctggcctaacccccatctccattcctgtgctgcacgtagggctcccagctcccccagcctaacagtttgcatgtggtcattgctgctgcaaggcggacagggctgaggatgctgctacaagcctcggggcaggtccaggtctccagctagctgccctcgtgctgtggaagggtgctttactgtgtgttcccgcagtgtctgtccacccagacctttgtggcagtcttacagctaaaactttgaccaaagctttggtcactttatgcaacctggttttgtactgtttctcagaggtgccttcttttttccaatccatactcaaataatagtctttgatgtctgtcttccttgacccgtgttcgtgcaaagattcagagtctgtgtgtggcttctactaggctgatgttacaccaggtgggtttattgagatatcatgtgtctgttcctccccctgtcctgcattcactcctgtggaggaaaggaggccacgatgtccctaaggaaagctttgtcctgagctcttcattcattggctaacccctagctcccttttcttctgccctttcacaccaggagaaataattttccattttgttcctattgctttggccttttgtattattctacccccttagtccctttgcagatccccactcctgctcagcaggctcttacctctgacccccagctttcattgtggctgttagcaacatcctggggtttaaactccacccacgcccgatctggctgtctagagggattctacgcctgcgtgctgccgcctccccaagaggcattcaggttattggagaactaatctcatctcaaggggccagacaccaagtcccaaagcctacagacctctttccgccaggccctgaaacctggccccgtgccagcaggatgacaagccccagggcgctcctgatgaatatggattggagatgatgtacagtttttattcccctctggcttttgaggaatgaaatgatttgcactttgaaaacctgttaaccgtagcctctggacactgagactggaaggagaataaaggatgcttgttgtttttaaactataccaggtttcccagatctcttggcttttttccacccagacggtagcagggggagtggttggggcacgtggctcttttccatctctttcaccctcaagttagtaaagtcgtttattcagatcacttactcagtgtagttataatttaattcagaccagttaaaaaaaaattgagaagtttctgtttccctccagcacactgccctgctgggaggcaagccaatatcaagtaactgtgggctaatcacatttttttccttatttacaattctgtgttaaattgtaaccctacaatcaaaaggtcgtgatcctataattaactcagaaaccaaggcggggttggtggaggaagagttagataattagttaagtacatatttttaagccatcatatatttgatgccatttgtgcatagaaattgtagagagtaataactgaaatggtaaacagaagaagaaa

SEQ ID NO: 300809 - DNA, 3736 bp, Homo sapiens
gcgctgtagtcgatagtgacacgtggtaaaggacaggtggtcggtcgaattccgtgatccatgggctgagcagttccctgactgactcctcctccccaggggtgggggctagctgccgcccatcctcccagcccatcatgagccagagcctccccaaagaagggccagataagtgttccatcagtgggcacgggagcctcaactccatcagccgccactcatccctgaagaatcggctggatagtccacagatccggaagactgccacagcgggaaggtcaaaaagcttcaataaccatcggcccatggaccctgaggtcattgctcaggatattgaggcaacaatgaactcggccctgaatgagctacgggaactagaacggcagagcagtgtcaaacacacccctgacgtggttctggacaccttggagcccctcaaaacctccccagtggtggcccccacgtcagagccctccagccctctgcacacccagctcctcaaggaccccgagcccgccttccagcgcagcgccagtactgctggggacatcgcctgcgccttccggcctgtcaagtctgtcaagatggctgccccggtcaaaccaccagccacacggcccaagcccactgtcttccccaaaacaaatgccactagccctggtgtcaactcatcaacttccccacagtctactgacaagtcttgtactgtctgagggataataatttaattgttctagacaaggggactatagggactgactgttattaaaatcttcctatttaactagcttggggacttcagttgaaaattaggttctaagttgttcttgcaggaattagcctccccgtctcccaaaaccttgagaatgaagcccttggtatcgcctctcccttcccactgccctctgcttcccccagtcgtcgtaattcagccagctgcagtccgtaccgttcttaggttagccagagacaggttttcattatcaggtcactgtgaaatctggtaaggcagtcctgaggacatgggctcaagtctcagtcccctcagaccacggtgatgccttgaccagatggttggctactgccatccagctttcagtggcatcttgttttgggaactgattatagagaatcatatatagtccagtcttcattttacatacacacacatattttacacacacacacattttacacacacacacacacacacacacacatatgtttttctagtctctggcatgtgtagcctctcctggtcatagaccagtctctttgtaagttattgtggcagttcacacagtagccaccaggggtctctgtttccatcacaaactttgttctgtctgggccagagaacctagcctttgaaatctctccatcatatgaaacataacgggatgggacaatcccgtaacctgtttggggttgggggctttctctctgtgttctttccattgatgtgaattggtcattggtgtttgctcttgcctctcctccatcccctagaagtacacccccgtcttattaaggagcttttaaagtttttctgaatgtatagacatttctcgggttcctacctttgtctctgatggaccattttccatttaagacattttcctgtataagacagttttatagctggttccttttagggtaaagagtcttaagagagttttattgtgtctatggcaggtttgggaaaggtaagaaatgggtcctttttcctcctaatgtttttggcacttaaaacataaaattcattatcctattaaaaaattaaattcagctttgctaatccagaaattgttcccaaatgaaaacttgttttaagtccaccccttagtttccttattttacaaggtctctcttcagggaccaacaggggcttagagagccttagttagattaaagggagaccctacctcttaaaaccagttttcatttatgcaaacaaggacaattaagggaaccctgaccccacaggctctcaagtcttcccaaggccagaatcgaaagaaaattaaaatttgaatgctgaatattctggctctactctggccttttttctggttcccttccaaaatgcacaaatcatacccttgtctgctccaattcagtctccaaacctggtgcctgtgctcctggcccccctagcatcatgctatcccaggagtatcaggaccagacacatccacagccaggctcatgggtctcagacagcaacttgagttaaagctgaaactcatccttcttctctgtgttttctggtttaaaagctgcacttatattttagccttattattttctgtagttccggagagatggtgggttgccattctggtaggaaaatctgagttttcttatctttgacctagaagagattctttttggaccaacctgcgaaattggtagttaggtctatggaaagtggtaggatttttttttttttaatcctgtgcaaaggaaaagaggtgctttgtgggaaatcactaatgagaaggctaacctgcagcaccagagaaacctttccaagtgctaggcaggagaactgaagaactctttcagtgaagtgagtcagcctagaagaggcaacccacagtcttgatttttgttgctgtttcctgacctgttcttgcctgtcacctgggcctacacaggtcccgagccaacggggctttcatacccaaggatctgtttccttgctgaaaatgaaaccctatctttcactttacattcctttcaatccaactgatcaaaactggtacccacacttgccctttctccctctctccagcacactcccctctaagaaagtaaaagcaaagctttcttaatggcaacactttgggcctgttctgttgctcctgccttatttctctttcaaccctgtacatgactcgtgttcaccatccccttgatcagtgtccatccgcgctaatttgcatcatgaactgaacagtgtgtgagtggtcacctactaaacccagctctgggggcagagctgtcttccccatctctggtgctcctaacacctgtgagatggtcctgtcgagaggactaggaaccgataggaggagagtccttctcggcagagctcactgcaaacaactggaattgaggttgcacactgtgatttttacaccgaaaagccaaaaggagctggccatccagggcctagggagaccagccttcctcagctatgcttgccgaaaccagcatgatgcttcaaagagccctgctccacccctcatggcatggatccttttcctggtgtggactctgaagggtcagtcttcggggaagagaggtggggtggggctactagcatcccaatttagaaaacagaggagtttgtagccagcagcctgtaaactggaaacactggtctcagccaacctcctcagggcgccctggcttctccccaaggagatgaggagcggtgatgccagcaccgggatgcgcagagcactggaagggctggtgcagatctacttcccatgcagaagagaagtcacatcttccagggaatcgcaatgttgtggcgtctgacttgtatgtcacatttgtgtaaaatggtatattctttaaaatagtgttgataactggaatattgtatgtatgcttggagatgctttgtgtgaacctaagactgtcactcaacagatgttggattggggaaaatccaaagcacaacttcaaaataaaatacatttttaggtttcaaaaaaaaaaa

SEQ ID NO: 300810 - DNA, 2835 bp, Homo sapiens
cgatcctttcatttgagcacaaacatcttatataatactatctcccttaccttctcccatttattaatcttttttctattctactattttcttccccctacttctattctaaatctttagtatccactcgtctacatctttcttactctgatcgttatcttctccgtcgtgacttggtagctccctgccgtatttaaatgacccaatctcattacattgtgaagatttccattttttaggttacgtaagaaattttggacctaaaaatcttgcattttaagacagtctttgtcagaattactttttggctctaaatgaattctgtaacatttgtattctaaattgacctttagtaaaagcaggaatggccatattcaaactggtaacctcgcaaatcctgcccaccctttcactttctgtctcaatacattgatgtcctctaacccatttcctgtcttatgtggctttagtgccacttatcaaaattgtgtgcaaatttccttggctaacagtaacagtttttgtctgggcttgtctagcagtggaattctgcctgagttcatcatttttgtgactggtacttgaagtgcatcagatgattaatttcatgataagagggctttttggggtggtgaaatagacatttatggaaaatgggatacccacattaagcagggtgactacctgtttaccatacaacccacacaaagccaatacaactatagatgtgctttctttagtctgttgcctctgcaaacattgcccgtgtgtttctctatgcccttcaaaaacatcagagcagcacatcctggaagatcctatcttttgtaagtttaagaagcagcctcttgtcacaggttgactcctaggtagtgtgcctagtgaccaagagggctgctaagaaagctttctgaccacttgtggctgtcattggactgatttgcccagatgacatcaattgggaatttgaggcatgacctataaagatcagttgcttgcaagagtctcaggaaaataattgtggagttaagaaacttgaagcgatttttaaaaattacctaacccaaccttctcatttgaaaaattaaaaaataaataggccagatatggcggctcatgcctgtaatcccagcgctgtgggagcctgaggcgggtgggtctcttgaggccaggagttcaagaccagcctggacaatgtggtgaaaccctgtctctactaaaaacacaaaaattagctgggtgtggtggcaggcgcctgtaatcccagctactcaggaggctaaggtgggaggattacttgaaccggggaggcataggttgtagtgagccaagatcgtgtcactgcactccagcctgggtgacagagtaagactctgcctaaaaaaaaaaaaagaaagattaaaaaataaataaatctgctgggcgtggtggctcacgcctgtaatcccagcactttgggaggccgaggcgggtggatcacctgaggtcgggagtttgagaccagcctgatcaacatggagaaacctcgtctctactaaaaacacgaaaaaattagctgggcgtggtggcgcatgcctcattcacgtacatgggagagtctacaaagtcacacgtattcataggttaagccacatgctgacaaatgtcataagaagaccctacacttttaccttggccgatccctcccctcagtgcaagctctgtgcaagagtgaacttgaacttcactcagtgcaagagtgaacacacactttgtgccggctttaaagaacccagcacaaagccagtctgcatggcctacagacatattttgctggacaatgattacttgcttttctttttgtttttcttgtatttgcctgtttgattggctcctgacataccagaaaatcactgtcaaaacattagcttaacatttgttaaggaaacaaaaagacttcggtgaccacaccttataaaccaaacagttttgtaaatcactttggaaaatttcactaaaaaaaaaaatccttaacaatataataagtaaagaaaatttaaaaccacaaaacatcactgtgttgtagggggaggtctgatttacagagtaaccacatagtaattataattattagaatgtccagttttcaaaaaacgttacaaggcatacaaagaatgggaaagtgtggctcattcaaaggaacaaaataaaagtgacagaaaatatccctaaagaaacccagacatcaaacttaccagacaaagactttaaaacaactgtcttcattatactcaaatgtcaaaaggaaaacataaacaaagaaataaaggaatcagaaaaaatattaaaaagtaggaatatcagcaaagagataacaaattctggagtggaaaactacaatgataaaaatttaaaaatcaccagagggatttaagagtatatttgcacacacagaggaagccatgaacttgaagagaagaaaatggaaaatactgtctctgagaaacagaaagaataaaaaataaacaatgagcagagactaatgaatttgtgggacatcatcaaatagaccaacattcatattctagaaggataaattatgttgttaaaaagtttaccattctttctttttcacctttcttccttcttccttccccctcctcctttttacttttcttcctcttcctttctcttcttcttttctcttataaccttgggtctcttttccttttctttttcttaattaatctaaaatgtagcgccggtgggaaggatgtccggtctttgatagtcaaagaaacacaaggcacggcgcccatgggggcggctcatgagtgaaagcacggcattctagga

SEQ ID NO: 300811 - DNA, 1176 bp, Homo sapiens
gctcggtacccactctgatccagtagaagaggcaacccacagtcttgatttttgttgctgtttcctgacctgttcttgcctgtcacctgggcctacacaggtcccgagccaacggggctttcatacccaaggatctgtttccttgctgaaaatgaaaccctatctttcactttacattcctttcaatccaactgatcaaaactggtacccacacttgccctttctccctctctccagcacactcccctctaagaaagtaaaagcaaagctttcttaatggcaacactttgggcctgttctgttgctcctgccttatttctctttcaaccctgtacatgactcgtgttcaccatccccttgatcagtgtccatccgcgctaatttgcatcatgaactgaacagtgtgtgagtggtcacctactaaacccagctctgggggcagagctgtcttccccatctctggtgctcctaacacctgtgagatggtcctgtcgagaggactaggaaccgataggaggagagtccttctcggcagagctcactgcaaacaactggaattgaggttgcacactgtgatttttacaccgaaaagccaaaaggagctggccatccagggcctagggagaccagccttcctcagctatgcttgccgaaaccagcatgatgcttcaaagagccctgctccacccctcatggcatggatccttttcctggtgtggactctgaagggtcagtcttcggggaagagaggtggggtggggctactagcatcccaatttagaaaacagaggagtttgtagccagcagcctgtaaactggaaacactggtctcagccaacctcctcagggcgccctggcttctccccaaggagatgaggagcggtgatgccagcaccgggatgcgcagagcactggaagggctggtgcagatctacttcccatgcagaagagaagtcacatcttccagggaatcgcaatgttgtggcgtctgacttgtatgtcacatttgtgtaaaatggtatattctttaaaatagtgttgataactggaatattgtatgtatgcttggagatgctttgtgtgaacctaagactgtcactcaacagatgttggattggggaaaatccaaagcacaacttcaaaataaaatacatttttaggtttcaaaaaaaaaaa

SEQ ID NO: 300812 - DNA, 3434 bp, Homo sapiens
acatgagaggtatgattggtggtggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacacttcctggccaagacacgcagcaccaaggaccagcaattcaagaaggatcagaatgttctctctccagtcaactgctggaatctcctcttaaaccaggtgaagtgggaaagcagggaccataccaccctgagtgacatctacctgaataatatcattcctcgatttgtacaagtcagcgaggactcaggaagactctttaaaaagagtaaagaagtcggccagcagctccaagatgatttgatgaaggtcctgaacgagctctactcggtcatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgtcaagccaagtacacggagaataagctgaaggccatcaaagcccggaatgagtacttgctggctttggaggcaaccaatgcatctgtcttcaagtactacatccatgacctatctgaccttattgatcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacaaaaatgaaagagtacctggagggcaggaacctcatcaccaagttacaagccaagcatgaccttctgcagaaaaccctgggagaaagtcagcggacagattgcagtctagccaggcgcagctcaactgtgaggaaacaggactccagccaggcaattcctctggtggtggaaagctgtatccggtttatcagcagacacggactacagcatgaaggaattttccgggtgtcaggatcccaggtggaagtgaatgacatcaaaaatgcctttgagagaggagaggaccccctggctggggaccagaacgaccatgacatggattccatagctggtgtcctgaagctttacttccgggggctggaacaccctctcttccccaaggacatctttcatgacctgatggcctgcgtcacaatggacaacctgcaggagagagctctgcacatccggaaagtcctcctagtcctgcccaaaaccactctgattatcatgagatacctctttgccttcctcaatcatttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactgtgatagccctcatggagagactacctcggttgaagactcaacccaggatgtgaccgcagagcaccacacgagcgatgacgaatgtgagcccatcgaggccattgccaagtttgactacgtgggccggacagcccgagagctgtcctttaagaagggagcatccctgctgctttaccagcgggcttccgacgactggtgggaaggccggcacaatggcatcgacggactcatcccccatcagtacatcgtggtccaagacaccgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaactttcattgtggctgttagcaacatcctggggtttaaactccacccacgcccgatctggctgtctagagggattctacgcctgcgtgctgccgcctccccaagaggcattcaggttattggagaactaatctcatctcaaggggccagacaccaagtcccaaagcctacagacctctttccgccaggccctgaaacctggccccgtgccagcaggatgacaagccccagggcgctcctgatgaatatggattggagatgatgtacagtttttattcccctctggcttttgaggaatgaaatgatttgcactttgaaaacctgttaaccgtagcctctggacactgagactggaaggagaataaaggatgcttgttgtttttaaactataccaggtttcccagatctcttggcttttttccacccagacggtagcagggggagtggttggggcacgtggctcttttccatctctttcaccctcaagttagtaaagtcgtttattcagatcacttactcagtgtagttataatttaattcagaccagttaaaaaaaaattgagaagtttctgtttccctccagcacactgccctgctgggaggcaagccaatatcaagtaactgtgggctaatcacatttttttccttatttacaattctgtgttaaattgtaaccctacaatcaaaaggtcgtgatcctataattaactcagaaaccaaggcggggttggtggaggaagagttagataattagttaagtacatatttttaagccatcatatatttgatgccatttgtgcatagaaattgtagagagtaataactgaaatggtaaacagaagaagaaa

SEQ ID NO: 300813 - DNA, 4022 bp, Homo sapiens
  misc_feature (3957)..(3957): n is a, c, g, or t
acatgagaggtatgattggtggtggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacacttcctggccaagacacgcagcaccaaggaccagcaattcaagaaggatcagaatgttctctctccagtcaactgctggaatctcctcttaaaccaggtgaagtgggaaagcagggaccataccaccctgagtgacatctacctgaataatatcattcctcgatttgtacaagtcagcgaggactcaggaagactctttaaaaagagtaaagaagtcggccagcagctccaagatgatttgatgaaggtcctgaacgagctctactcggtcatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgtcaagccaagtacacggagaataagctgaaggccatcaaagcccggaatgagtacttgctggctttggaggcaaccaatgcatctgtcttcaagtactacatccatgacctatctgaccttattgatcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggcttcccagctctgtgcccagcagcctgtccagagtgagctggtacagagatgccaacaactgcagtctcgcttatccactctaaagattgaaaacgaagaggtaaagaagacaatggaggccaccctgcaaaccatccaggacattgtgactgtcgaggactttgatgtgtctgactgcttccagtacagcaactccatggagtccgtcaagtccacggtctctgaaaccttcatgagcaagcccagcattgctaagaggagagccaaccagcaagagacagagcagttttatttcacaaaaatgaaagagtacctggagggcaggaacctcatcaccaagttacaagccaagcatgaccttctgcagaaaaccctgggagaaagtcagcggacagattgcagtctagccaggcgcagctcaactgtgaggaaacaggactccagccaggcaattcctctggtggtggaaagctgtatccggtttatcagcagacacggactacagcatgaaggaattttccgggtgtcaggatcccaggtggaagtgaatgacatcaaaaatgcctttgagagaggagaggaccccctggctggggaccagaacgaccatgacatggattccatagctggtgtcctgaagctttacttccgggggctggaacaccctctcttccccaaggacatctttcatgacctgatggcctgcgtcacaatggacaacctgcaggagagagctctgcacatccggaaagtcctcctagtcctgcccaaaaccactctgattatcatgagatacctctttgccttcctcaatcatttatcacagttcagtgaagagaacatgatggacccctacaacctcgccatctgcttcgggccctcgctaatgtcagtgccagagggccacgaccaggtgtcctgccaagcccacgtgaatgagctgatcaaaaccatcatcatccagcatgagaacatcttcccaagccccagggagctggagggccctgtctacagcagaggaggaagcatggaggattactgtgatagccctcatggagagactacctcggttgaagactcaacccaggatgtgaccgcagagcaccacacgagcgatgacgaatgtgagcccatcgaggccattgccaagtttgactacgtgggccggacagcccgagagctgtcctttaagaagggagcatccctgctgctttaccagcgggcttccgacgactggtgggaaggccggcacaatggcatcgacggactcatcccccatcagtacatcgtggtccaagacacgttgatatcctgagtgagtctgcaccctcccagcctcttcccggctcgttctgcagggaaatcctccctctgttgatagcatcgcaaacctggtggcaatctgtgcgtggacaggaccctcccaaatttagcattatgacttcaccacaggatcaagagaagatgaattgtgggggagaaggggctttctttgtcatcagtagccagaggggccaggagagcagtggagagacctgggaccggcttggatgctctgagcggggctagaggcgctacgacagtgtgtggcggtgtcctgccacgacgccgccgtctccagagccaccacacagttgactgtccttacccggcagtgctcaggacctcagccgataaaccacaacctggacttgccgcctccttctccaggaggccgccccagcacggcctccccaggaagcagcatggggtagaaggcagatgcctcgaatccaggtgtcccctagccacgctttcctgaggagctgaggagcccgcagaactcagcggattatttatttttatttaaacgacccttcaaaggcccttaggtttccttgcctctgctcacagaactagtccagccaggtgtcgctgctgcctcagagctgtgtggggtcgcgtgtatgtcggggggccatcttgccgatttaacgctgctttttgtgttgttgttgttttccctcctccctgcctgcctgccccttctcccccagcgaggacggtgtcgtggagaggtccagccccaagtctgagattgaggtcatttctgagccacctgaagaaaaggtgacagccagagcgggggccagctgtcccagtgggggtcatgtagccgatatttatcttgcaaacatcaacaagtaagctctgcttttcattttctgctcccctgaatgacttgcaacacccagcctcaccctctggcctaacccccatctccattcctgtgctgcacgtagggctcccagctcccccagcctaacagtttgcatgtggtcattgctgctgcaaggcggacagggctgaggatgctgctacaagcctcggggcaggtccaggtctccagctagctgccctcgtgctgtggaagggtgctttactgtgtgttcccgcagtgtctgtccacccagacctttgtggcagtcttacagctaaaactttgaccaaagctttggtcactttatgcaacctggttttgtactgtttctcagaggtgccttcttttttccaatccatactcaaataatagtctttgatgtctgtcttccttgacccgtgttcgtgcaaagattcagagtctgtgtgtggcttctactaggctgatgttacaccaggtgggtttattgagatatcatgtgtctgttcctccccctgtcctgcattcactcctgtggaggaaaggaggccacgatgtccctaaggaaagctttgtcctgagctcttcattcattggctaacccctagctcccttttcttctgccctttccccgggaanatttccttggtcctgggtgggctgggtttttaccctttcctgggaccccggtggggcttcacttc

SEQ ID NO: 300814 - DNA, 1195 bp, Homo sapiens
acatgagaggtatgattggtggtggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacacttcctggccaagacacgcagcaccaaggaccagcaattcaagaaggatcagaatgttctctctccagtcaactgctggaatctcctcttaaaccaggtgaagtgggaaagcagggaccataccaccctgagtgacatctacctgaataatatcattcctcgatttgtacaagtcagcgaggactcaggaagactctttaaaaagagtaaagaagtcggccagcagctccaagatgatttgatgaaggtcctgaacgagctctactcggtcatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagcgtcaagccaagtacacggagaataagctgaaggccatcaaagcccggaatgagtacttgctggctttggaggcaaccaatgcatctgtcttcaagtactacatccatgacctatctgaccttattgatcagtgttgtgacttaggctaccatgcaagtctgaaccgggctctacgcaccttcctctctgctgagttaaacctggaacagtcgaagcatgagggtctggatgccatcgagaatgcagtagaaaacctggatgccaccagtgacaagcagcgcctcatggagatgtacaacaacgtcttctgcccccctatgaagtttgagtttcagccccacatgggggatatggtgaggccctttccctatacccccaccctcaaggggcttgagtggagttgtctagatt

SEQ ID NO: 300815 - DNA, 820 bp, Homo sapiens
acatgagaggtatgattggtggtggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacacttcctggccaagacacgcagcaccaaggaccagcaattcaagaaggatcagaatgttctctctccagtcaactgctggaatctcctcttaaaccaggtgaagtgggaaagcagggaccataccaccctgagtgacatctacctgaataatatcattcctcgatttgtacaagtcagcgaggactcaggaagactctttaaaaagagtaaagaagtcggccagcagctccaagatgatttgatgaaggtcctgaacgagctctactcggtcatgaagacatatcacatgtacaatgccgacagcatcagtgctcagagcaaactaaaggaggcggagaagcaggaggagaagcaaattggtaaatcggtaaagcaggaggaccggcagaccccacgctcccctgactccacggccaacgttcgcattgaggagaaacatgtccggaggagctcagtgaagaagattgagaagatgaaggagaagatggcccagaagcgtcctgcctgcacctgaattctga

SEQ ID NO: 300816 - DNA, 5027 bp, Homo sapiens
  misc_feature (84)..(84): n is a, c, g, or t
  misc_feature (115)..(115): n is a, c, g, or t
atgggtggaaacatgattcaaacttacacaatttttcttgctatttttcaaatatgaatcttactatatattctcggtgaacancaggagactattaaagaggtctgctgttaantgtaaagaaaaaatgctcgtagctatttgcttcctggtattggagcagttcagttgtttagtttataccattggattcaattcattgcaccatggttgccaaaagtgcctgaggtcataatggattgttaaaataactaaattccagtggttggaaactctaggtttgtaccattttttctgctgtgggaaaaaacaacaacaacaacatgatcaaggtaacatcacatttgatgtataatattatactattaatggaatatcagtagacaactgttaacccattagtagcatgagtataaacagtacacctgaataaattggagacattagccactaggtttaacagtggaatcttgatttgcctaggtgacttctgggattactgtttgacaaataagagtaacattttatttcatttcagaatttacgtcacttttagctacaagagtaggaagaaggtaatcggcaaggcagaagagtatactctttgccttaggatagcgtaaactcaggctgagacatacccggcttatagagttcttctagatgtgtagactgtaaatgcccaaatcctctcaactaaagttttagtgattccacaaagcctctcatgtaaatttccagtgattccaccattgcacttgtgaatatgtatccttgttagtacccagggatgtcctcgagcaccagttttattttatctgccattgcatctggattccattacagcctctcagctgttactgcctgtggacagttacttctgcttactgcctgtagagagttacctaacttctcttctcagttcttcctcaggtcctggctattttggcctcagttgaagggagtcttgctctcatctctgagggttttaagtttgtttgatcccattgttgtcttttctagctttgagcatgtttttcagtattcatattttaacttactgagaacattaaagggaaatgataaactcgtggtggggatatggcagacaggtgcttgtttgtttgagagaagtagcagaagagataaaatacaaagtgctatatgtttcagctggagaggaaagagagagaatttattagattatatacttgtcccatggcataccacgtatatgtttaaatagggacacatctccctatgtttaactatacttataaacaactttgatacacattgcgtcttttattctgtcacctgatattttagtgtatctcaagttacagattacatgtgtccttaaactatttctgaatttggacttagttccatatacagaaagaactttagaaaattcattaatttggatcttctattgatagccataaatattatgtttatgtattctaaaacctctttgtttagttagtactgttcatgaatgtaacaagcttcaatttctcatttgtgagtagtacatttgctttttgtttgtttgtttgtttgtttttgagatggagtctcacgctgtcaccaggctggagtgcagtggcgcgatttcagctcactgcaacctccacctcccaggtgcaagtgatgcccctgcctcagcctcccgagtagctgggactacagacacccgccaccacacctggctaatttttgtatttttagtagagacggggtttcaccatgttggctaggctggtctcaaactcttgacctcgtgatttgcccgcctctgcctccccaaagtgctgggattacaggcgtgagccaccacgcccagccgtacatttactttttaaagcagcagactaggtacactaattctcactcaaatattttcatgggaatgtagttatcaccaagtcctaaagtattatttatgccaaaaaaaatttcattttaaggactacaaaaatgattctaattaaacattttataatcaatagtaggttgggtctttagccattatatgtgtatatatacagacacatatgtatacacttacattttgacagggtcttcattgagtcttgatgcactttaaacccagctggctaccagagatgcgaaggtgggctctttgaagattagcaaaatggacgtttctgtcacttgagaaaaggaaagttctttgcctttaaattacacagttttcatcatgcccacaatctatattattggctggttaaacagcactgccctattagcaatgttaacaaaaatgaaattatttattggcggttatagattatctaattcaggaaatttctgagctcaacttttacagcaactgttatgccttctaatttagcaattgagttatgagtaagttttgtgcttaactcctagaccctattgttgataaccagatcaaatatagtctgtacagaggaaaacactgggaacatttagtatttctaaagcctcctttggagttactactgattgtaatttggaactgataataggtagagattgctaacactgttttttttcctggatcttttttatgccagaaattaaacaggttctgctaactcttttttttctcttggttatcaccagaatgaaaatatttaaagtgatgactctagaaaagccatctgtgcctggttaacattgagtttgagtctcttcaatatatattgatcatgtattgattaatctttattttttcatattttggctagacaaattcagatctatataatggaataccccttcttgagtgaactatactactaatctacatgattatatagtaaggaaaaaagaagaaataactgtaataggcatagtgtttgttgttggttgtcttgtcattcatgtgatactactcatttccaaaattcacacaaacttacatgaggtggattatttgttttgttcattatttagttcctatatgttttttctttagaaacagagtctcattctgtcacccaggctggagtccaatggggcggtcatagttcactgcagccttgaactctttggctcatgtgatcctcccatctcagcctcccacagcaggtgagactacaggtacatgccactgtgcctgactttttaatttttttgtagagacgaggtttcagtttgttgcccaagctgatcttgaactcctggtttcaagcgatcctcccacctcggcctcccaaagtagtgggatttcaggcatgaccacctggcctagttcctatacttttcttaattcttcagacttctcacatttagtatagtgcattcatttcatcttgctgtttattagcaccctttgtggccaagggaaataaaaggtggtaaaattcagttttcagtttagttcttgaaagctctgggaaatggaggaaacacaaaactatgaattaaactagggctgttgatttctgaacccccagataaatcagttgacccacattttcattttaggtgttaggtccaaattagcataatgtcttgcattattattaggttcagtgtgaaactttacagtgctgcatttgaagtttagtaactggttattattaatcatttgggaaaaatgaaaatgtgttgggactttctatgactaggcatttgttgattatttttcatgattgctttttgttttctcattgtgtaggatttgtgaacttgtatattacaggaaacaagatactttgtaaaatttactggggaaaatccatttggagtgcatgacatttgccaggataagaaagcagtaatatgtttgtattataaaattacaccctgccagaaaactttctttcctagtaaggtaaatgtagaagggacttttacagcatagtaagttgattaggagccaaaattttattccagttttttttgaactaagaatgttttaaattctgtaatgaacttttatgtttacccattactcatgcattctttcacaatatgtttaatagcctgaggaaataggaaagctgtgaagctactaccattctttacttttaataagaataataggaaagaaaagtcaggtcagtaatccaaatccaaatatgtatactgcaaatgctcaagaagtcacattttttgataaattgtattgagtacagaagaacttatatgaatttattatctgttaataacttagttttgacaacagaataacatttggaaattgtgagaataatcaagctgtttttccattaacagtgtaaattcataacatgtccttcaaaaggtgatattctaagctgtcttaattgtctacggttgataacttttaaataaagtacaggactttctgaaagtgtttggcatgttatgctgccaaaaacaatctgtgttttgaaataccaattaatcagttaatttctgaagactttgtataggacttgatatatgagtcagaatctgtctgtactcattctgtacattgtaactttgaacacttatgaaaaactgtatctgttggtgtgttttgattagttagtgtagatttgtttgcgtatttgaattccgattttagtttaggaagactaaaagtagccatttttgtaaagttcatatgctattttttaatgtcatttttgtttttaatatttatacaatagtgatgttactagtaaaaaatgtttatagataacacgtagagctattaactgttcaaaagcctacatgataggcatattttgtatttcgtgttgcactcgttctgtttcatattggactttttacatcccttttttagcaaaaaaaagagacacatttgaattctctttagcataaagctgtgcattggaaactatgtgactgtatccatacggttagcaaaatactctttgccaccaaaggtaaatgaaactgtaaaatacctctggatatttgtgccaatgaacttttcttagcatattaggattaaagcaaaaataatcttttcagtatgtttcatctaggacttacaataaatgtttaaaccatgaaaa

SEQ ID NO: 300817 - DNA, 4963 bp, Homo sapiens
  misc_feature (84)..(84): n is a, c, g, or t
  misc_feature (115)..(115): n is a, c, g, or t
atgggtggaaacatgattcaaacttacacaatttttcttgctatttttcaaatatgaatcttactatatattctcggtgaacancaggagactattaaagaggtctgctgttaantgtaaagaaaaaatgctcgtagctatttgcttcctggtattggagcagttcagttgtttagtttataccattggattcaattcattgcaccatggttgccaaaagtgcctgaggtcataatggattgttaaaataactaaattccagtggttggaaactctaggtttgtaccattttttctgctgtgggaaaaaacaacaacaacaacatgatcaaggtaacatcacatttgatgtataatattatactattaatggaatatcagtagacaactgttaacccattagtagcatgagtataaacagtacacctgaataaattggagacattagccactaggtttaacagtggaatcttgatttgcctaggtgacttctgggattactgtttgacaaataagagtaacattttatttcatttcagaatttacgtcacttttagctacaagagtaggaagaaggtaatcggcaaggcagaagagtatactctttgccttaggatagcgtaaactcaggctgagacatacccggcttatagagttcttctagatgtgtagactgtaaatgcccaaatcctctcaactaaagttttagtgattccacaaagcctctcatgtaaatttccagtgattccaccattgcacttgtgaatatgtatccttgttagtacccagggatgtcctcgagcaccagttttattttatctgccattgcatctggattccattacagcctctcagctgttactgcctgtggacagttacttctgcttactgcctgtagagagttacctaacttctcttctcagttcttcctcaggtcctggctattttggcctcagttgaagggagtcttgctctcatctctgagggttttaagtttgtttgatcccattgttgtcttttctagctttgagcatgtttttcagtattcatattttaacttactgagaacattaaagggaaatgataaactcgtggtggggatatggcagacaggtgcttgtttgtttgagagaagtagcagaagagataaaatacaaagtgctatatgtttcagctggagaggaaagagagagaatttattagattatatacttgtcccatggcataccacgtatatgtttaaatagggacacatctccctatgtttaactatacttataaacaactttgatacacattgcgtcttttattctgtcacctgatattttagtgtatctcaagttacagattacatgtgtccttaaactatttctgaatttggacttagttccatatacagaaagaactttagaaaattcattaatttggatcttctattgatagccataaatattatgtttatgtattctaaaacctctttgtttagttagtactgttcatgaatgtaacaagcttcaatttctcatttgtgagtagtacatttgctttttgtttgtttgtttgtttgtttttgagatggagtctcacgctgtcaccaggctggagtgcagtggcgcgatttcagctcactgcaacctccacctcccaggtgcaagtgatgcccctgcctcagcctcccgagtagctgggactacagacacccgccaccacacctggctaatttttgtatttttagtagagacggggtttcaccatgttggctaggctggtctcaaactcttgacctcgtgatttgcccgcctctgcctccccaaagtgctgggattacaggcgtgagccaccacgcccagccgtacatttactttttaaagcagcagactaggtacactaattctcactcaaatattttcatgggaatgtagttatcaccaagtcctaaagtattatttatgccaaaaaaaatttcattttaaggactacaaaaatgattctaattaaacattttataatcaatagtaggttgggtctttagccattatatgtgtatatatacagacacatatgtatacacttacattttgacagggtcttcattgagtcttgatgcactttaaacccagctggctaccagagatgcgaaggtgggctctttgaagattagcaaaatggacgtttctgtcacttgagaaaaggaaagttctttgcctttaaattacacagttttcatcatgcccacaatctatattattggctggttaaacagcactgccctattagcaatgttaacaaaaatgaaattatttattggcggttatagattatctaattcaggaaatttctgagctcaacttttacagcaactgttatgccttctaatttagcaattgagttatgagtaagttttgtgcttaactcctagaccctattgttgataaccagatcaaatatagtctgtacagaggaaaacactgggaacatttagtatttctaaagcctcctttggagttactattttatgccagaaattaaacaggttctgctaactcttttttttctcttggttatcaccagaatgaaaatatttaaagtgatgactctagaaaagccatctgtgcctggttaacattgagtttgagtctcttcaatatatattgatcatgtattgattaatctttattttttcatattttggctagacaaattcagatctatataatggaataccccttcttgagtgaactatactactaatctacatgattatatagtaaggaaaaaagaagaaataactgtaataggcatagtgtttgttgttggttgtcttgtcattcatgtgatactactcatttccaaaattcacacaaacttacatgaggtggattatttgttttgttcattatttagttcctatatgttttttctttagaaacagagtctcattctgtcacccaggctggagtccaatggggcggtcatagttcactgcagccttgaactctttggctcatgtgatcctcccatctcagcctcccacagcaggtgagactacaggtacatgccactgtgcctgactttttaatttttttgtagagacgaggtttcagtttgttgcccaagctgatcttgaactcctggtttcaagcgatcctcccacctcggcctcccaaagtagtgggatttcaggcatgaccacctggcctagttcctatacttttcttaattcttcagacttctcacatttagtatagtgcattcatttcatcttgctgtttattagcaccctttgtggccaagggaaataaaaggtggtaaaattcagttttcagtttagttcttgaaagctctgggaaatggaggaaacacaaaactatgaattaaactagggctgttgatttctgaacccccagataaatcagttgacccacattttcattttaggtgttaggtccaaattagcataatgtcttgcattattattaggttcagtgtgaaactttacagtgctgcatttgaagtttagtaactggttattattaatcatttgggaaaaatgaaaatgtgttgggactttctatgactaggcatttgttgattatttttcatgattgctttttgttttctcattgtgtaggatttgtgaacttgtatattacaggaaacaagatactttgtaaaatttactggggaaaatccatttggagtgcatgacatttgccaggataagaaagcagtaatatgtttgtattataaaattacaccctgccagaaaactttctttcctagtaaggtaaatgtagaagggacttttacagcatagtaagttgattaggagccaaaattttattccagttttttttgaactaagaatgttttaaattctgtaatgaacttttatgtttacccattactcatgcattctttcacaatatgtttaatagcctgaggaaataggaaagctgtgaagctactaccattctttacttttaataagaataataggaaagaaaagtcaggtcagtaatccaaatccaaatatgtatactgcaaatgctcaagaagtcacattttttgataaattgtattgagtacagaagaacttatatgaatttattatctgttaataacttagttttgacaacagaataacatttggaaattgtgagaataatcaagctgtttttccattaacagtgtaaattcataacatgtccttcaaaaggtgatattctaagctgtcttaattgtctacggttgataacttttaaataaagtacaggactttctgaaagtgtttggcatgttatgctgccaaaaacaatctgtgttttgaaataccaattaatcagttaatttctgaagactttgtataggacttgatatatgagtcagaatctgtctgtactcattctgtacattgtaactttgaacacttatgaaaaactgtatctgttggtgtgttttgattagttagtgtagatttgtttgcgtatttgaattccgattttagtttaggaagactaaaagtagccatttttgtaaagttcatatgctattttttaatgtcatttttgtttttaatatttatacaatagtgatgttactagtaaaaaatgtttatagataacacgtagagctattaactgttcaaaagcctacatgataggcatattttgtatttcgtgttgcactcgttctgtttcatattggactttttacatcccttttttagcaaaaaaaagagacacatttgaattctctttagcataaagctgtgcattggaaactatgtgactgtatccatacggttagcaaaatactctttgccaccaaaggtaaatgaaactgtaaaatacctctggatatttgtgccaatgaacttttcttagcatattaggattaaagcaaaaataatcttttcagtatgtttcatctaggacttacaataaatgtttaaaccatgaaaa

SEQ ID NO: 300818 - DNA, 5446 bp, Homo sapiens
  misc_feature (84)..(84): n is a, c, g, or t
  misc_feature (115)..(115): n is a, c, g, or t
atgggtggaaacatgattcaaacttacacaatttttcttgctatttttcaaatatgaatcttactatatattctcggtgaacancaggagactattaaagaggtctgctgttaantgtaaagaaaaaatgctcgtagctatttgcttcctggtattggagcagttcagttgtttagtttataccattggattcaattcattgcaccatggttgccaaaagtgcctgaggtcataatggattgttaaaataactaaattccagtggttggaaactctaggtttgtaccattttttctgctgtgggaaaaaacaacaacaacaacatgatcaaggtaacatcacatttgatgtataatattatactattaatggaatatcagtagacaactgttaacccattagtagcatgagtataaacagtacacctgaataaattggagacattagccactaggtttaacagtggaatcttgatttgcctaggtgacttctgggattactgtttgacaaataagagtaacattttatttcatttcagaatttacgtcacttttagctacaagagtaggaagaaggtaatcggcaaggcagaagagtatactctttgccttaggatagcgtaaactcaggctgagacatacccggcttatagagttcttctagatgtgtagactgtaaatgcccaaatcctctcaactaaagttttagtgattccacaaagcctctcatgtaaatttccagtgattccaccattgcacttgtgaatatgtatccttgttagtacccagggatgtcctcgagcaccagttttattttatctgccattgcatctggattccattacagcctctcagctgttactgcctgtggacagttacttctgcttactgcctgtagagagttacctaacttctcttctcagttcttcctcaggtcctggctattttggcctcagttgaagggagtcttgctctcatctctgagggttttaagtttgtttgatcccattgttgtcttttctagctttgagcatgtttttcagtattcatattttaacttactgagaacattaaagggaaatgataaactcgtggtggggatatggcagacaggtgcttgtttgtttgagagaagtagcagaagagataaaatacaaagtgctatatgtttcagctggagaggaaagagagagaatttattagattatatacttgtcccatggcataccacgtatatgtttaaatagggacacatctccctatgtttaactatacttataaacaactttgatacacattgcgtcttttattctgtcacctgatattttagtgtatctcaagttacagattacatgtgtccttaaactatttctgaatttggacttagttccatatacagaaagaactttagaaaattcattaatttggatcttctattgatagccataaatattatgtttatgtattctaaaacctctttgtttagttagtactgttcatgaatgtaacaagcttcaatttctcatttgtgagtagtacatttgctttttgtttgtttgtttgtttgtttttgagatggagtctcacgctgtcaccaggctggagtgcagtggcgcgatttcagctcactgcaacctccacctcccaggtgcaagtgatgcccctgcctcagcctcccgagtagctgggactacagacacccgccaccacacctggctaatttttgtatttttagtagagacggggtttcaccatgttggctaggctggtctcaaactcttgacctcgtgatttgcccgcctctgcctccccaaagtgctgggattacaggcgtgagccaccacgcccagccgtacatttactttttaaagcagcagactaggtacactaattctcactcaaatattttcatgggaatgtagttatcaccaagtcctaaagtattatttatgccaaaaaaaatttcattttaaggactacaaaaatgattctaattaaacattttataatcaatagtaggttgggtctttagccattatatgtgtatatatacagacacatatgtatacacttacattttgacagggtcttcattgagtcttgatgcactttaaacccagctggctaccagagatgcgaaggtgggctctttgaagattagcaaaatggacgtttctgtcacttgagaaaaggaaagttctttgcctttaaattacacagttttcatcatgcccacaatctatattattggctggttaaacagcactgccctattagcaatgttaacaaaaatgaaattatttattggcggttatagattatctaattcaggaaatttctgagctcaacttttacagcaactgttatgccttctaatttagcaattgagttatgagtaagttttgtgcttaactcctagaccctattgttgataaccagatcaaatatagtctgtacagaggaaaacactgggaacatttagtatttctaaagcctcctttggagttactactgattgtaatttggaactgataataggtagagattgctaacactgttttttttcctggatcttttttatgccagaaattaaacaggttctgctaactcttttttttctcttggttatcaccagaatgaaaatatttaaagtgatgactctagaaaagccatctgtgcctggttaacattgagtttgagtctcttcaatatatattgatcatgtattgattaatctttattttttcatattttggctagacaaattcagatctatataatggaataccccttcttgagtgaactatactactaatctacatgattatatagtaaggaaaaaagaagaaataactgtaataggcatagtgtttgttgttggttgtcttgtcattcatgtgatactactcatttccaaaattcacacaaacttacatgaggtggattatttgttttgttcattatttagttcctatatgttttttctttagaaacagagtctcattctgtcacccaggctggagtccaatggggcggtcatagttcactgcagccttgaactctttggctcatgtgatcctcccatctcagcctcccacagcaggtgagactacaggtacatgccactgtgcctgactttttaatttttttgtagagacgaggtttcagtttgttgcccaagctgatcttgaactcctggtttcaagcgatcctcccacctcggcctcccaaagtagtgggatttcaggcatgaccacctggcctagttcctatacttttcttaattcttcagacttctcacatttagtatagtgcattcatttcatcttgctgtttattagcaccctttgtggccaagggaaataaaaggtggtaaaattcagttttcagtttagttcttgaaagctctgggaaatggaggaaacacaaaactatgaattaaactagggctgttgatttctgaacccccagataaatcagttgacccacattttcattttaggtgttaggtccaaattagcataatgtcttgcattattattaggttcagtgtgaaactttacagtgctgcatttgaagtttagtaactggttattattaatcatttgggaaaaatgaaaatgtgttgggactttctatgactaggcatttgttgattatttttcatgattgctttttgttttctcattgtgtaggatttgtgaacttgtatattacaggaaacaagatactttgtaaaatttactggggaaaatccatttggagtgcatgacatttgccaggataagaaagcagtaatatgtttgtattataaaattacaccctgccagaaaactttctttcctagtaaggtaaatgtagaagggacttttacagcatagtaagttgattaggagccaaaattttattccagttttttttgaactaagaatgttttaaattctgtaatgaacttttatgtttacccattactcatgcattctttcacaatatgtttaatagcctgaggaaataggaaagctgtgaagctactaccattctttacttttaataagaataataggaaagaaaagtcaggtcagtaatccaaatccaaatatgtatactgcaaatgctcaagaagtcacattttttgataaattgtattgagtacagaagaacttatatgaatttattatctgttaataacttagttttgacaacagaataacatttggaaattgtgagaataatcaagctgtttttccattaacagtgtaaattcataacatgtccttcaaaaggtgatattctaagctgtcttaattgtctacggttgataacttttaaataaagtacaggactttctgaaagtgtttggcatgttatgctgccaaaaacaatctgtgttttgaaataccaattaatcagttaatttctgaagactttgtataggacttgatatatgagtcagaatctgtctgtactcattctgtacattgtaactttgaacacttatgaaaaactgtatctgttggtgtgttttgattagttagtgtagatttgtttgcgtatttgaattccgattttagtttaggaagactaaaagtagccatttttgtaaagttcatatgctattttttaatgtcatttttgtttttaatatttatacaatagtgatgttactagtaaaaaatgtttatagataacacgtagagctattaactgttcaaaagcctacatgataggcatattttgtatttcgtgttgcactcgttctgtttcatattggactttttacatcccttttttagcaaaaaaaagagacacatttgaattctctttagcataaagctgtgcattggaaactatgtgactgtatccatacggttagcaaaatactctttgccaccaaaggtaaatgaaactgtaaaatacctctggatatttgtgccaatgaacttttcttagcatattaggattaaagcaaaaataatcttttcagtatgtttcatctaggacttacaataaatgtttaaaccatgaaaaaaaaaaaaaaaaaaacaaaaaaaaaaaagaaaacaaaaaaaaaaaatcacccacaaaaaggagcccccaaaaaacacccatcacacaaagaagccaacatagacaaacaagaggaacccataaatcggggcacgccacagtagaaaaccaccaacaagaacatggccactcaccattgaacacacaaaggcaacgaacacccggagcaacaaatggcaaacaccacgacaaccatcgagcggagcacaacagcaacccctccaaacctaactcaagagaggaggaagcacaccacgcgcggaaaccaatggataacgggaaccacaaaatctcggacgagacccaacagaggtcgacgacgaacaaacaacacgcccacggagggttcaacaggacacaaaaaaaagacgggaataccc

SEQ ID NO: 300819 - DNA, 5359 bp, Homo sapiens
  misc_feature (84)..(84): n is a, c, g, or t
  misc_feature (115)..(115): n is a, c, g, or t
atgggtggaaacatgattcaaacttacacaatttttcttgctatttttcaaatatgaatcttactatatattctcggtgaacancaggagactattaaagaggtctgctgttaantgtaaagaaaaaatgctcgtagctatttgcttcctggtattggagcagttcagttgtttagtttataccattggattcaattcattgcaccatggttgccaaaagtgcctgaggtcataatggattgttaaaataactaaattccagtggttggaaactctaggtttgtaccattttttctgctgtgggaaaaaacaacaacaacaacatgatcaaggtaacatcacatttgatgtataatattatactattaatggaatatcagtagacaactgttaacccattagtagcatgagtataaacagtacacctgaataaattggagacattagccactaggtttaacagtggaatcttgatttgcctaggtgacttctgggattactgtttgacaaataagagtaacattttatttcatttcagaatttacgtcacttttagctacaagagtaggaagaaggtaatcggcaaggcagaagagtatactctttgccttaggatagcgtaaactcaggctgagacatacccggcttatagagttcttctagatgtgtagactgtaaatgcccaaatcctctcaactaaagttttagtgattccacaaagcctctcatgtaaatttccagtgattccaccattgcacttgtgaatatgtatccttgttagtacccagggatgtcctcgagcaccagttttattttatctgccattgcatctggattccattacagcctctcagctgttactgcctgtggacagttacttctgcttactgcctgtagagagttacctaacttctcttctcagttcttcctcaggtcctggctattttggcctcagttgaagggagtcttgctctcatctctgagggttttaagtttgtttgatcccattgttgtcttttctagctttgagcatgtttttcagtattcatattttaacttactgagaacattaaagggaaatgataaactcgtggtggggatatggcagacaggtgcttgtttgtttgagagaagtagcagaagagataaaatacaaagtgctatatgtttcagctggagaggaaagagagagaatttattagattatatacttgtcccatggcataccacgtatatgtttaaatagggacacatctccctatgtttaactatacttataaacaactttgatacacattgcgtcttttattctgtcacctgatattttagtgtatctcaagttacagattacatgtgtccttaaactatttctgaatttggacttagttccatatacagaaagaactttagaaaattcattaatttggatcttctattgatagccataaatattatgtttatgtattctaaaacctctttgtttagttagtactgttcatgaatgtaacaagcttcaatttctcatttgtgagtagtacatttgctttttgtttgtttgtttgtttgtttttgagatggagtctcacgctgtcaccaggctggagtgcagtggcgcgatttcagctcactgcaacctccacctcccaggtgcaagtgatgcccctgcctcagcctcccgagtagctgggactacagacacccgccaccacacctggctaatttttgtatttttagtagagacggggtttcaccatgttggctaggctggtctcaaactcttgacctcgtgatttgcccgcctctgcctccccaaagtgctgggattacaggcgtgagccaccacgcccagccgtacatttactttttaaagcagcagactaggtacactaattctcactcaaatattttcatgggaatgtagttatcaccaagtcctaaagtattatttatgccaaaaaaaatttcattttaaggactacaaaaatgattctaattaaacattttataatcaatagtaggttgggtctttagccattatatgtgtatatatacagacacatatgtatacacttacattttgacagggtcttcattgagtcttgatgcactttaaacccagctggctaccagagatgcgaaggtgggctctttgaagattagcaaaatggacgtttctgtcacttgagaaaaggaaagttctttgcctttaaattacacagttttcatcatgcccacaatctatattattggctggttaaacagcactgccctattagcaatgttaacaaaaatgaaattatttattggcggttatagattatctaattcaggaaatttctgagctcaacttttacagcaactgttatgccttctaatttagcaattgagttatgagtaagttttgtgcttaactcctagaccctattgttgataaccagatcaaatatagtctgtacagaggaaaacactgggaacatttagtatttctaaagcctcctttggagttactactgattgtaatttggaactgataataggtagagattgctaacactgttttttttcctggatcttttttatgccagaaattaaacaggttctgctaactcttttttttctcttggttatcaccagaatgaaaatatttaaagtgatgactctagaaaagccatctgtgcctggttaacattgagtttgagtctcttcaatatatattgatcatgtattgattaatctttattttttcatattttggctagacaaattcagatctatataatggaataccccttcttgagtgaactatactactaatctacatgattatatagtaaggaaaaaagaagaaataactgtaataggcatagtgtttgttgttggttgtcttgtcattcatgtgatactactcatttccaaaattcacacaaacttacatgaggtggattatttgttttgttcattatttagttcctatatgttttttctttagaaacagagtctcattctgtcacccaggctggagtccaatggggcggtcatagttcactgcagccttgaactctttggctcatgtgatcctcccatctcagcctcccacagcaggtgagactacaggtacatgccactgtgcctgactttttaatttttttgtagagacgaggtttcagtttgttgcccaagctgatcttgaactcctggtttcaagcgatcctcccacctcggcctcccaaagtagtgggatttcaggcatgaccacctggcctagttcctatacttttcttaattcttcagacttctcacatttagtatagtgcattcatttcatcttgctgtttattagcaccctttgtggccaagggaaataaaaggtggtaaaattcagttttcagtttagttcttgaaagctctgggaaatggaggaaacacaaaactatgaattaaactagggctgttgatttctgaacccccagataaatcagttgacccacattttcattttaggtgttaggtccaaattagcataatgtcttgcattattattaggttcagtgtgaaactttacagtgctgcatttgaagtttagtaactggttattattaatcatttgggaaaaatgaaaatgtgttgggactttctatgactaggcatttgttgattatttttcatgattgctttttgttttctcattgtgtaggatttgtgaacttgtatattacaggaaacaagatactttgtaaaatttactggggaaaatccatttggagtgcatgacatttgccaggataagaaagcagtaatatgtttgtattataaaattacaccctgccagaaaactttctttcctagtaaggtaaatgtagaagggacttttacagcatagtaagttgattaggagccaaaattttattccagttttttttgaactaagaatgttttaaattctgtaatgaacttttatgtttacccattactcatgcattctttcacaatatgtttaatagcctgaggaaataggaaagctgtgaagctactaccattctttacttttaataagaataataggaaagaaaagtcaggtcagtaatccaaatccaaatatgtatactgcaaatgctcaagaagtcacattttttgataaattgtattgagtacagaagaacttatatgaatttattatctgttaataacttagttttgacaacagaataacatttggaaattgtgagaataatcaagctgtttttccattaacagtgtaaattcataacatgtccttcaaaaggtgatattctaagctgtcttaattgtctacggttgataacttttaaataaagtacaggactttctgaaagtgtttggcatgttatgctgccaaaaacaatctgtgttttgaaataccaattaatcagttaatttctgaagactttgtataggacttgatatatgagtcagaatctgtctgtactcattctgtacattgtaactttgaacacttatgaaaaactgtatctgttggtgtgttttgattagttagtgtagatttgtttgcgtatttgaattccgattttagtttaggaagactaaaagtagccatttttgtaaagttcatatgctattttttaatgtcatttttgtttttaatatttatacaatagtgatgttactagtaaaaaatgtttatagataacacgtagagctattaactgttcaaaagcctacatgataggcatattttgtatttcgtgttgcactcgttctgtttcatattggactttttacatcccttttttagcaaaaaaaagagacacatttgaattctctttagcataaagctgtgcattggaaactatgtgactgtatccatacggttagcaaaatactctttgccaccaaaggtaaatgaaactgtaaaatacctctggatatttgtgccaatgaacttttcttagcatattaggattaaagcaaaaataatcttttcagtatgtttcatctaggacttacaataaatgtttaaaccatgaaaaaaaaaaaatagaaaacaaaaaaaaaaaaaggaagaaagtagaagaaaattataaacataggggggggacaaaagagaatgggtacaccacacaggaacataacgagtacaagaggaggcacgaaataacatgataggagaacaaagaaggacacgacagaacaggagagagcgaaataaacaaagaaagaaaacaggaacaaaaaggaaaaacagagaggacaactagagagaaaaacagcgaacaaaagaggaggaggaaaaaaaaaaagcggcacgagagcgcaacaacaagaggacgcccacaaggagaagaaacaaaaaaaaaggaaa

SEQ ID NO: 300820 - DNA, 1748 bp, Homo sapiens
aaccttatccttataatattatacacacaggtaagaaataatcatttcaacactagacattgaataaccctacagaccgtagaactctctcttagctttaaaatagactattatctcagtaatattcattcccgtagcactattcgtcacatgatcaattatagaattctccatatgatacatacactcagataaatcagttgacccacattttcattttaggtgttaggtccaaattagcataatgtcttgcattattattaggttcagtgtgaaactttacagtgctgcatttgaagtttagtaactggttattattaatcatttgggaaaaatgaaaatgtgttgggactttctatgactaggcatttgttgattatttttcatgattgctttttgttttctcattgtgtaggatttgtgaacttgtatattacaggaaacaagatactttgtaaaatttactggggaaaatccatttggagtgcatgacatttgccaggataagaaagcagtaatatgtttgtattataaaattacaccctgccagaaaactttctttcctagtaaggtaaatgtagaagggacttttacagcatagtaagttgattaggagccaaaattttattccagttttttttgaactaagaatgttttaaattctgtaatgaacttttatgtttacccattactcatgcattctttcacaatatgtttaatagcctgaggaaataggaaagctgtgaagctactaccattctttacttttaataagaataataggaaagaaaagtcaggtcagtaatccaaatccaaatatgtatactgcaaatgctcaagaagtcacattttttgataaattgtattgagtacagaagaacttatatgaatttattatctgttaataacttagttttgacaacagaataacatttggaaattgtgagaataatcaagctgtttttccattaacagtgtaaattcataacatgtccttcaaaaggtgatattctaagctgtcttaattgtctacggttgataacttttaaataaagtacaggactttctgaaagtgtttggcatgttatgctgccaaaaacaatctgtgttttgaaataccaattaatcagttaatttctgaagactttgtataggacttgatatatgagtcagaatctgtctgtactcattctgtacattgtaactttgaacacttatgaaaaactgtatctgttggtgtgttttgattagttagtgtagatttgtttgcgtatttgaattccgattttagtttaggaagactaaaagtagccatttttgtaaagttcatatgctattttttaatgtcatttttgtttttaatatttatacaatagtgatgttactagtaaaaaatgtttatagataacacgtagagctattaactgttcaaaagcctacatgataggcatattttgtatttcgtgttgcactcgttctgtttcatattggactttttacatcccttttttagcaaaaaaaagagacacatttgaattctctttagcataaagctgtgcattggaaactatgtgactgtatccatacggttagcaaaatactctttgccaccaaaggtaaatgaaactgtaaaatacctctggatatttgtgccaatgaacttttcttagcatattaggattaaagcaaaaataatcttttcagtatgtttcatctaggacttacaataaatgtttaaaccatgaaaa

SEQ ID NO: 300821 - DNA, 316 bp, Homo sapiens
tcactaagcgtaatcatttctagctttcgatttaaagtgagataggcgggactcttcctttcacttgaacactatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaaca

SEQ ID NO: 300822 - DNA, 312 bp, Homo sapiens
cggaagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattgcctcgtacgggtgagactcaggtgggctacgtcagttgggtacattc

SEQ ID NO: 300823 - DNA, 1401 bp, Homo sapiens
cggaagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcttggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacagtacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagagggacactttgccaccatcaccttgaccttcatcgacaagaacggagagactgagctgtgcatggaaggtcgaggcatccctgctcctgaggaagagcggacacgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaaca

SEQ ID NO: 300824 - DNA, 1373 bp, Homo sapiens
  misc_feature (14)..(14): n is a, c, g, or t
  misc_feature (22)..(22): n is a, c, g, or t
taaaagggaggggnagaaaacntaggctaggtacgaggcctgggtggtgcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcttggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacagtacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagagggacactttgccaccatcaccttgaccttcatcgacaagaacggagagactgagctgtgcatggaaggtcgaggcatccctgctcctgaggaagagcggacacgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaaca

SEQ ID NO: 300825 - DNA, 1338 bp, Homo sapiens
  misc_feature (14)..(14): n is a, c, g, or t
  misc_feature (22)..(22): n is a, c, g, or t
taaaagggaggggnagaaaacntaggctaggtacgaggcctgggtggtgctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcttggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacagtacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagagggacactttgccaccatcaccttgaccttcatcgacaagaacggagagactgagctgtgcatggaaggtcgaggcatccctgctcctgaggaagagcggacacgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaaca

SEQ ID NO: 300826 - DNA, 2354 bp, Homo sapiens
  misc_feature (2116)..(2116): n is a, c, g, or t
cggaagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcttggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacagtacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagagggacactttgccaccatcaccttgaccttcatcgacaagaacggagagactgagctgtgcatggaaggtcgaggcatccctgctcctgaggaagagcggacacgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaacaaaaaaaaaaaaaaaaaaaaaaaaaaaaaaaaaaaaaaaaaaaaacaaaaaaaaaaaaaaaaaaaaaaaaaaaaaaggggggggcgcggcgcgcgcgcgcgcgccccgagaggctcaaccccccgtgtgggggggcgcgggcgccacccaagtagaatatagcgaacaccgcgaggcacacagcgtgtctccctcagagaaaacctgcggcgcacaaaacaaagggcggggtggtctcttcccccataaaataacacaccggggggagacgaccgggagcttgttctgaaacacacccccagggggtgtcgggaagaggcgactcgaggggcctcaaacaagcagggggacaccaaagaggcgcgcagacaacaaaatcaccccccccgccggcgggggggtaagacaagaactaacaaaacaccaagctacaacatagagaacactacacacagacacaatacacgcacactgcacatgtaaacgaagtactacaagggacagcaaacaaaacacgagactaaacgagtcaaataacagctacagtacaacaacgacgacaaacaagcaagagatagccacgaggtagaaacgcacgcagcacagtacagaccagaagccatacaaccgcagaaccagaacgaggaagcaacaacacgaagcaggggaacgtagacaagaaacatgacacagagcgagacaagcagaaagcaccnagcaaaacatagcaagccagcacacgagcagacacatagcagcacaagacaacaacgcaaaggagtcgatcgcaggcatagtcgcagtgagccaccaaacacaagaagcaggacaatagagagaatcgacagcgatagcaacaagacacgaaaagacaacaaacaacacaagcgcgagacaagaaggaaagcacaacaacgcaacaacgcaagagaagcacacaagaaaaaacaaaga

SEQ ID NO: 300827 - DNA, 1492 bp, Homo sapiens
cggaagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcttggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacagtacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagagggacactttgccaccatcaccttgaccttcatcgacaagaacggagagactgagctgtgcatggaaggtcgaggcatccctgctcctgaggaagagcggacacgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaacaaaaacagaaacagacaaagcaaacgaacacagaaacgacaacaaaaacacaaacaaaacaaaagggcgccaatataaaaacctcgggagaa

SEQ ID NO: 300828 - DNA, 1362 bp, Homo sapiens
  misc_feature (1336)..(1336): n is a, c, g, or t
cggaagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcttggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacagtacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagagggacactttgccaccatcaccttgaccttcatcgacaagaacggagagactgagctgtgcatggaaggtcgaggcatccctgctcctgaggaagagcggacacgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgtcgngctagtcgaaaggggatcgtctagag

SEQ ID NO: 300829 - DNA, 1609 bp, Homo sapiens
cggaagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcttggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacagtacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagaggggtctcactgtcactcaggctagagtgcagtggcataatcacagcaaactgcagccttaacctcccagacccaaacgatcctcctgcttcagcttcccaagtagctgagacttacaggtgtgagccaccacgcccagccaggttgccccagtcttaaactcagatggaaacctagatatgaaacctccgtcccctctgcctttcccaggacactttgccaccatcaccttgaccttcatcgacaagaacggagagactgagctgtgcatggaaggtcgaggcatccctgctcctgaggaagagcggacacgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaaca

SEQ ID NO: 300830 - DNA, 1236 bp, Homo sapiens
cgcgttgggtgaggtacagggcgatgttctccagcagagcctggttgggcctcttcctcacggctttccgggctgccatatagaggttgcactgactgaccaaggcccgcatctcttccatgacggtgcgggtgtcaacattgtcacaaagagccggcgcgtgtgaggtgacggaagtgagtaagcttgatggagaggcatccattaacaatcgcaaagggaaacttatcttcttttatgaatggagcgtcaaactaaactggacaggtacttctaagtcaggagtacagtacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagagggacactttgccaccatcaccttgaccttcatcgacaagaacggagagactgagctgtgcatggaaggtcgaggcatccctgctcctgaggaagagcggacacgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaaca

SEQ ID NO: 300831 - DNA, 1181 bp, Homo sapiens
cggaagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcttggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacagtacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagaggggtctcactgtcactcaggctagagtgcagtggcataatcacagcaaactgcagccttaacctcccagacccaaacgatcctcctgcttcagcttcccaagtagctgagactacgtgtgccaccatgccagcttttttttttttttttttttttttacttttttactttttttgta

SEQ ID NO: 300832 - DNA, 1034 bp, Homo sapiens
aaggctaggtacgaggcctggttgagaatcggccgaggaatggagcgtcaaactaaactggacaggtacttctaagtcaggagtacagtacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagagggacactttgccaccatcaccttgaccttcatcgacaagaacggagagactgagctgtgcatggaaggtcgaggcatccctgctcctgaggaagagcggacacgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaaca

SEQ ID NO: 300833 - DNA, 1323 bp, Homo sapiens
cggaagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcttggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacagtacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtagaggtgctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagagggacactttgccaccatcaccttgaccttcatcgacaagaacggagagactgagctgtgcatggaaggtcgaggcatccctgctcctgaggaagagcggacacgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaaca

SEQ ID NO: 300834 - DNA, 1188 bp, Homo sapiens
cggaagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcttggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacagtacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagagaggtggtcgaggcatccctgctcctgaggaagagcggacacgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaaca

SEQ ID NO: 300835 - DNA, 1283 bp, Homo sapiens
cggaagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcttggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacagtacaaaggacatgtggagatccccaatttgtctgatgaaaacagcgtggatgaagtggagagttcacccagggcatgatcttacctacaatgaatggagagtcagtagacccagtggggcagccagcactgaaaactgaggagcgcaaggctaagcctgctccttcaaaaacccaggccagacctgttggagtcaaaatccccacttgtaagatcactcttaaggaaaccttcctgacgtcaccagaggagctctatagagtgtttaccacccaagagctggtgcaggcctttacccatgctcctgcaacattagaagcagacagaggtggaaagttccacatggtagatggcaacgtctctggggaatttactgatctggtccctgagaaacatattgtgatgaagtggaggtttaaatcttggccagagggacactttgccaccatcaccttgaccttcatcgacaagaacggagagactgagctgtgcatggaaggtcgaggcatccctgctcctgaggaagagcggacacgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaaca

SEQ ID NO: 300836 - DNA, 1039 bp, Homo sapiens
  misc_feature (730)..(730): n is a, c, g, or t
  misc_feature (734)..(734): n is a, c, g, or t
  misc_feature (738)..(738): n is a, c, g, or t
  misc_feature (748)..(748): n is a, c, g, or t
  misc_feature (758)..(758): n is a, c, g, or t
  misc_feature (762)..(762): n is a, c, g, or t
  misc_feature (769)..(769): n is a, c, g, or t
  misc_feature (772)..(772): n is a, c, g, or t
cggaagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcttggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacagtacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgggaatttacatcagcaccctcaaaacagagttcacccagggcatgatcttacctacaatgaatggagagtcagtagacccagtggggcagccagcactgaaaactgaggagcgcaaggctaagcntgtncttnaaaaccaggncagactgtgnagtnaaatccnatngtagaatattcttaaggaagcttctgaggtacaacgaggaaatcaatgagtgattacaacaagaagtgggtgaggctaaccaggtactgagattagagaggacgagtgaagtcccaggtgaggagtctgggaatcgaacgccgaaaatgtgaacaggggtaatatgagagagagagaacgaaatcaaagggatggaggggagaatacagagacaggagcaatggaaagcaatagggacactgtaagtggtgtttttttaattatggg

SEQ ID NO: 300837 - DNA, 687 bp, Homo sapiens
tgtccaggctagtctcgaactcctgggctcaagtgatcctcctgcctcagcctcccaaagtgctgggattacaggtgcatgccaccacgcccacgtaattttagtagagatggagtttcaccatgttagccaggctggtctggaactcctgacctctggtgatccgcccacctcagcctgccaaagtgctgggattacaggtgtgagccaccacgcccagccaggttgccccagtcttaaactcagatggaaacctagatatgaaacctccgtcccctctgcctttcccaggacactttgccaccatcaccttgaccttcatcgacaagaacggagagactgagctgtgcatggaaggtcgaggcatccctgctcctgaggaagagcggacacgacagggctggcagcggtactactttgagggcattaaacagacctttggctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaaca

SEQ ID NO: 300838 - DNA, 760 bp, Homo sapiens
cggaagttaaggaggggagggggtggagggaaaagcaagccaggaggtgcttgcggccgcttctagtagtttccaggcgctgccgggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacggataagctgaaaacactgttcttggcagtgcaggttcaaaatgaagaaggcaagtgtgaggtgacggaagtgagtaagcttgatggagaggcatccattaacaatcgcaaagggaaacttatcttcttttatgaatggagcgtcaaactaaactggacaggtacttctaagtcaggagtacagtacaaaggacatgtggagatccccaatttgtctgatgaaaacagcgtggatgaagtggagctatggcgcacgcttattttagggccagcggcaggggactccagcctgctggacacttcagtccagctctctcctgactggggcttgcgactcacaggattgcatcgtcccagctgctaacttggggccggggcccctcccttccacatataccttgggtttgtgcatgttttctgctgggtgggttcagagggcaatttctcttttatgtgtacatatgctaaataaacataatttaaaaaaca

SEQ ID NO: 300839 - DNA, 342 bp, Homo sapiens
cttgccaaagatgagcctgacacaaatctcgtggccttaatgaaggaagaaggggtgaaacttctaagagaagcaatgggaatttacatcagcaccctcaaaacaggtatcccttgagtagttctgtatgccttaaggaggtagtttccacctgttagactctggttaagggcctggacagtcctttctttggcaaatgggtaaagatttggggggagggggcttatttcatcttaaagtcagtccataagctcggagtaagggaaagatctggagctgtgttgcctaataatgatggttgagcattttagatgtggctagaccaaactgaaatgtactgtg

SEQ ID NO: 300840 - DNA, 282 bp, Homo sapiens
tgacatgggttctaactaacattagccacttgacagagaggactcaagaaggaacactaatggggattgtacgaataccgcagtactcatgcatttcctttggaaatgtcagcagtcacctgattgctcagcccccacattccataatgagggtgcccctcaagttatttaccacctacttctcatctttcacccagattagtgtgagccttgccaaagatgagcctgacacaaatctcgtggccttaatgaaggaagaaggggtgaaacttctaagagaag

SEQ ID NO: 300841 - DNA, 610 bp, Homo sapiens
ttacatccctgtcttcacccaatctccccaattttcagggtgagcaagtactttatctagagatggaagtttgtggttcaagctcagcacttggtttagagccctgttgctcttttgtcagcatagtgaagtggatactctggaagtggggagaaaaccgcttccagctatttaaacatagaaattgtttgagaattacactgagctcttcaaaaatatctcaatgatttgatttgttatttgactatcagggtcttccttgtagagtggttatttttactgggaattgaggaggtttccagaatcattaccctcatgactgaaacacctacacactcaaattcccttcaaaccccttggaataattacccttggaggtgaacatttttatgagaatgaatggtacaactgtctctgaagccacgttgattgaggttgtatcattactctgtattgatcattttcactgccaccttcacaggctaagcctgctccttcaaaaacccaggccagacctgttggagtcaaaatccccacttgtaagatcactcttaaggaaaccttcctgacgtcaccagaggagctctatagagtgtttaccacccaagag

SEQ ID NO: 300842 - DNA, 3668 bp, Homo sapiens
ccccgcgcggcgcgggccagggaagggccacccaggggtcccccacttcccgcttgggcgcccggacggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacatggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctgtgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttta

SEQ ID NO: 300843 - DNA, 523 bp, Homo sapiens
aggctccggatccctctgggaggtagatttgaggacagattggaattgaggtgaaagacagagaaagagaagtggccaggatgactccaagatttctgacctaaactactgggaaggacgcggttgtcatttctgaaatgcagaaggatgccagaagagaaggtactttggggaggggcgggaatcaggagttagttttggacatgagataagcttggaatatttatttgctatctaagacagctccttaacatggtaagcccttatgcaagttgttgtcagctgagatgggcgtggcactgagcatgggagcatggaggcgcctgagtggtctcatgctcaggtggtttagcaaactcagtgtacatcctgccaattccagtcctgccatggccactgacaagctaggagggcgctgaaaggagaaggaccccgatgtctcctccagcccatccatctcctctctcccattggccaaacccaaccggaaactaaaggccaagggtacccggtgatgaagact

SEQ ID NO: 300844 - DNA, 513 bp, Homo sapiens
gtcacacgggctacccccacaggccgccatcttggaaaaggccaatggctgtggaatcattcttgactcctattagccttcctgttctctctcccgccccacagcatccatcctgtcagcaaatcctgtgggctctgtcttcaacacagatgacatgaaaaattgctgtgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctctttattttttatgtattaaccaaacatacctccagac

SEQ ID NO: 300845 - DNA, 409 bp, Homo sapiens
  misc_feature (332)..(332): n is a, c, g, or t
gtcacacgggctacccccacaggccgccatcttggaaaaggccaatggctgtggaatcattcttgactcctattagccttcctgttctctctcccgccccacagcatccatcctgtcagcaaatcctgtgggctctgtcttcaacacagatctttggtaagtcctcaaaactttacttttgtttgaaatctaattttaaaaaattacatcagagggaagccaggcgtgatgcctcatgcctgtaatgccagcacttagggaggtcaaggcaggtagattgctttagcttcagaagttcaagaccagcccgggcaagatggcgaaactccgcnctctatgaaaaaatccggaaattagccaggcatggtgacatgagcatgcagtctcagccacttgggaggctgaggta

SEQ ID NO: 300846 - DNA, 221 bp, Homo sapiens
accgagtggacgatgaatggtcccaccattgcagcaccgagctccgctgttgtaccagctggtttttctgctctccgagtgccttggcatctcccaatggggtggctttgctctgggctcctgttccctgtgagctgcctggtcctgctgcaggtggcaagctctggactcttcaggatgccgtgtggagaaaggaagagggtggaagccaggaggtctgg

SEQ ID NO: 300847 - DNA, 3446 bp, Homo sapiens
tctagaggtccccaccaacattggctcgacctgccagtcctttagaaagatcacccagtgctttttgtataccaaaccctatttgaaatacttacgtatattaacccatttccttatcaccacaaccctgcgggaagggagataggcacttttattatcttcattttgcagatgaggacattgaggtccagagaggttatgtcacttacttaaggtcacacagccaggaagtggtagtagggactcttacccttgttttacagatgagattgaattatctcacaaaaactcagaaaggttaaacaacttgcctaagtaacatacagctaattagtcgaggagcctgacgcatgttgctctagcctggtcacagttacagaggtggcaagcaatggcctgaacaggacgaacaaccaaatacccaggctggtggctcttaaacatggtggggtcagctaacgacagcaaccagggtgggcactggtgcccctcgcccccggctggtgccctaacatctcccttttctctaccagttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacatggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctgtgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttta

SEQ ID NO: 300848 - DNA, 3535 bp, Homo sapiens
ccccgcgcggcgcgggccagggaagggccacccaggggtcccccacttcccgcttgggcgcccggacggcgaatggagcaggggcgcgcaggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacatggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctgtgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttta

SEQ ID NO: 300849 - DNA, 4273 bp, Homo sapiens
ccccgcgcggcgcgggccagggaagggccacccaggggtcccccacttcccgcttgggcgcccggacggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtcctcccacctttgaaacggagctggtcgcagtagaccaccaagcccccttcagcccagctgtttccacccctgaacttaagtgcccaggaaggcgtattgagatgaggtgtgcttgctggaaggcatgcctgctgctgattgaaaaccgaactgggaacagtccttccattctgtgtccactggtcagctgctgcggctttggatggtcttgaccgtggaaggctgaccttcttctggtacccggagtccctgcaggaatcccccttgagcttgctgggctgtggtgacaggagtttaaaacatgcgttgtattccagtgatgcatgatatgacatgcatcacaggaataaaaacctgaggtctcatggatatgattgcttcaaaggagaccaagttttaaaacagatgaatcaaaataaagaaaaatactcagtaaatcatcataaagtacagagatgtggccaaaggtgtgaaggatgcagctgtaaaagctgaagtttgaggccgggtgtggtggttcatgcctataatcccagcactttgggaggccgagcccagcggatcaccggaggtcaggagttcgagaccagcctggacaacatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacatggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctgtgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttta

SEQ ID NO: 300850 - DNA, 3518 bp, Homo sapiens
aggctccggatccctctgggaggtagatttgaggacagattggaattgaggtgaaagacagagaaagagaagtggccaggatgactccaagatttctgacctaaactactgggaaggacgcggttgtcatttctgaaatgcagaaggatgccagaagagaagggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacatggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctgtgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttta

SEQ ID NO: 300851 - DNA, 4191 bp, Homo sapiens
ccccgcgcggcgcgggccagggaagggccacccaggggtcccccacttcccgcttgggcgcccggacggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgcccaggaaggcgtattgagatgaggtgtgcttgctggaaggcatgcctgctgctgattgaaaaccgaactgggaacagtccttccattctgtgtccactggtcagctgctgcggctttggatggtcttgaccgtggaaggctgaccttcttctggtacccggagtccctgcaggaatcccccttgagcttgctgggctgtggtgacaggagtttaaaacatgcgttgtattccagtgatgcatgatatgacatgcatcacaggaataaaaacctgaggtctcatggatatgattgcttcaaaggagaccaagttttaaaacagatgaatcaaaataaagaaaaatactcagtaaatcatcataaagtacagagatgtggccaaaggtgtgaaggatgcagctgtaaaagctgaagtttgaggccgggtgtggtggttcatgcctataatcccagcactttgggaggccgagcccagcggatcaccggaggtcaggagttcgagaccagcctggacaacatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacatggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctgtgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttta

SEQ ID NO: 300852 - DNA, 3490 bp, Homo sapiens
tctagaggtccccaccaacattggctcgacctgccagtcctttagaaagatcacccagtgctttttgtataccaaaccctatttgaaatacttacgtatattaacccatttccttatcaccacaaccctgcgggaagggagataggcacttttattatcttcattttgcagatgaggacattgaggtccagagaggttatgtcacttacttaaggtcacacagccaggaagtggtagtagggactcttacccttgttttacagatgagattgaattatctcacaaaaactcagaaaggttaaacaacttgcctaagtaacatacagctaattagtcgaggagcctgacgcatgttgctctagcctggtcacagttacagaggtggcaagcaatggcctgaacaggacgaacaaccaaatacccaggctggtggctcttaaacatggtggggtcagctaacgacagcaaccagggtgggcactggtgcccctcgcccccggctggtgccctaacatctcccttttctctaccagttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacatggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctgtgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctctttaaaaaaaacaaaagaactcgcagacatattcaccctcggggccaa

SEQ ID NO: 300853 - DNA, 3224 bp, Homo sapiens
gcccacggcagccttggcgtctacagcaatgcatagccctgcttaaatgctctcctatggccgggtgtggtggttcatgcctataatcccagcactttgggaggccgagcccagcggatcaccggaggtcaggagttcgagaccagcctggacaacatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacatggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctgtgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttta

SEQ ID NO: 300854 - DNA, 1573 bp, Homo sapiens
tctagaggtccccaccaacattggctcgacctgccagtcctttagaaagatcacccagtgctttttgtataccaaaccctatttgaaatacttacgtatattaacccatttccttatcaccacaaccctgcgggaagggagataggcacttttattatcttcattttgcagatgaggacattgaggtccagagaggttatgtcacttacttaaggtcacacagccaggaagtggtagtagggactcttacccttgttttacagatgagattgaattatctcacaaaaactcagaaaggttaaacaacttgcctaagtaacatacagctaattagtcgaggagcctgacgcatgttgctctagcctggtcacagttacagaggtggcaagcaatggcctgaacaggacgaacaaccaaatacccaggctggtggctcttaaacatggtggggtcagctaacgacagcaaccagggtgggcactggtgcccctcgcccccggctggtgccctaacatctcccttttctctaccagttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggcccttgggcacctcgacttgtgaacgagttgttggctgctccctccacagcttctgcagcagactgtccctgttgtaactgcccaaggcatgttttgcccaccagatcatggcccacatggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctgtgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttta

SEQ ID NO: 300855 - DNA, 1396 bp, Homo sapiens
tctagaggtccccaccaacattggctcgacctgccagtcctttagaaagatcacccagtgctttttgtataccaaaccctatttgaaatacttacgtatattaacccatttccttatcaccacaaccctgcgggaagggagataggcacttttattatcttcattttgcagatgaggacattgaggtccagagaggttatgtcacttacttaaggtcacacagccaggaagtggtagtagggactcttacccttgttttacagatgagattgaattatctcacaaaaactcagaaaggttaaacaacttgcctaagtaacatacagctaattagtcgaggagcctgacgcatgttgctctagcctggtcacagttacagaggtggcaagcaatggcctgaacaggacgaacaaccaaatacccaggctggtggctcttaaacatggtggggtcagctaacgacagcaaccagggtgggcactggtgcccctcgcccccggctggtgccctaacatctcccttttctctaccagttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggcggggcatcaggccagtgcctggaaggtgtggccaaaggggtctctagctgctgctctgctgctcctgctcatggatgagtttggcgatggggccggtgatgccgcctatcaaggtccagtactcatcgaagctgatgcgcccatcatgattggcatccaggttctggatgagcttatccgcagccttcagataaaatg

SEQ ID NO: 300856 - DNA, 953 bp, Homo sapiens
ccccgcgcggcgcgggccagggaagggccacccaggggtcccccacttcccgcttgggcgcccggacggcgaatggagcaggggcgcgcaggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagatttagacagaatggcgggatcagatcccctacgcccctccgcaaccgcctcgctcgcgtattattattcgga

SEQ ID NO: 300857 - DNA, 373 bp, Homo sapiens
  misc_feature (347)..(347): n is a, c, g, or t
tctagaggtccccaccaacattggctcgacctgccagtcctttagaaagatcacccagtgctttttgtataccaaaccctatttgaaatacttacgtatattaacccatttccttatcaccacaaccctgcgggaagggagataggcacttttattatcttcattttgcagatgaggacattgaggtccagagaggttatgtcacttacttaaggtcacacagccaggaagtggtagtagggactcttacccttgttttacagatgagattgaattatctcacaaaaactcagaaaggttaaacaacttgcctaagtaacatacagctaattagtcggccaatgttnggtgtgatactctagaatcagctata

SEQ ID NO: 300858 - DNA, 867 bp, Homo sapiens
ccccgcgcggcgcgggccagggaagggccacccaggggtcccccacttcccgcttgggcgcccggacggcgaatggagcaggggcgcgcaggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactgtgagtatcaagaggcctaagcaatggtaatctccactctccattcttcccctgtggccagacacttcccctggctgagtctctgggc

SEQ ID NO: 300859 - DNA, 1391 bp, Homo sapiens
ccccgcgcggcgcgggccagggaagggccacccaggggtcccccacttcccgcttgggcgcccggacggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtcctcccacctttgaaacggagctggtcgcagtagaccaccaagcccccttcagcccagctgtttccacccctgaacttaagtgcccaggaaggcgtattgagatgaggtgtgcttgctggaaggcatgcctgctgctgattgaaaaccgaactgggaacagtccttccattctgtgtccactggtcagctgctgcggctttggatggtcttgaccgtggaaggctgaccttcttctggtacccggagtccctgcaggaatcccccttgagcttgctgggctgtggtgacaggagtttaaaacatgcgttgtattccagtgatgcatgatatgacatgcatcacaggaataaaaacctgaggtctcatggatatgattgcttcaaaggagaccaagttttaaaacagatgaatcaaaataaagaaaaatactcagtaaatcatcataaagtacagagatgtggccaaaggtgtgaaggatgcagctgtaaaagctgaagtttgaggccgggtgtggtggttcatgcctataatcccagcactttgggaggccgagcccagcggatcaccggaggtcaggagttcgagaccagcctggacaacatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatcttaacgtgatccgaatatcctg

SEQ ID NO: 300860 - DNA, 687 bp, Homo sapiens
ccccgcgcggcgcgggccagggaagggccacccaggggtcccccacttcccgcttgggcgcccggacggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttta

SEQ ID NO: 300861 - DNA, 666 bp, Homo sapiens
ccccgcgcggcgcgggccagggaagggccacccaggggtcccccacttcccgcttgggcgcccggacggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatggtgagcagggcggagtgcggcaggggtggctgggtgtgttcccacagctgcctgggctgaggg

SEQ ID NO: 300862 - DNA, 400 bp, Homo sapiens
tcaagcgatcctccctcctcagcctcctaaagtgctgggattacaggcgtgagccaccgcacccggcttccatatcctttctaattggtcatggcttgggataatggtgttgcttttaattatcatcatccataaagactttttcttactcaacagatctgagcttgtatttggtgcccaggacatgtgctgggttcccgaaatcccaaagacacagaccctaccctcagggatttctcattctagcaacatagactgatcaattactgattataacgttagaaggcatgtctgaagtagacagccatcaggacatggtgatttcaggctgggctttgaagaatgaataggagtttttcaagtgtcgaaactgaaccctgaccaacctttgcttttgcag

SEQ ID NO: 300863 - DNA, 536 bp, Homo sapiens
ggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgattagagatagtgataagtactgggacagacataaacagggtgctgtgataagaagtcacagggagggcccgcattagttgaggggggtcagagaaggcttctgaagtgtttctggtgcaaatgcttggaaaagggagagctgggagtgtatcccagggctgaggccaatggaggattgcagaagagggagaggggataggaggggaatgttagagggataagcaggggaattggctcttttcttcattttcttaaattaaactttttattttcagataattaaagatttacacacagctggaagaaatcatagagaagccgggcgtggtggctcatgcctataatcccagcactttt

SEQ ID NO: 300864 - DNA, 446 bp, Homo sapiens
aactcctcacctcaagtgatccacccacttcggcctcccaaagtgctgggattacaggcatgagccaccatgcccagccccatctctctttaaaaaacaaacaaacaaacaaaaaacataaaaagaagcagagaacacatacacatctgcatcttcccttgtttacttaacaatagatcttggaagtcacttctcagtagaggctaggttgggcagagcattggattctaggccagtgagtttggacttgaccatggagacactaggaagcccatgaaggacagagagagatgcccctgccagtcctttagaaagatcacccagtgctttttgtataccaaaccctatttgaaatacttacgtatattaacccatttccttatcaccacaaccctgcgggaagggagataggcacttttattatcttcattttgcagatgaggaca

SEQ ID NO: 300865 - DNA, 1166 bp, Homo sapiens
tcctgcctcagcctcctgagtagctgggactacaggcgtgtgccaccacacccagccaatttttgtagttttagtagaaatggggtttcaccatgttggccaggatggtctcgatctcttgacctcgtgatccacctgcctcggcctcccaaagtactgggattacgcgtgagctactgcacccggctgagtgatttttttttttttttttttaagatagagaaagtccctcatactgaggagccttgcagttgagagagaacagaattccagttggaggatcaaggaatttgagggaggcagcatgcttgcagtgttcctaggatttttacaggaactacaatagaaagttagggatgaaattatattgaaaggggaaagctggactgctcaggtttggaggtcatggggaattccaggattcagtatgtggttgctctcttatttttaacttctgcttagcagtaaaaccacacccttccttcttcctgaaagtaatgtttaacttcctctccctgcagcattacactctatgtaatgggagtggggtggaggaagagtctcccaaggtggttggatctcactattctactggaagaggagcaggcaaatatatttttatgtggtataatgtcattagattatttcctgctgcttaagacagagcaacttctggatgacattttggaatgtattctgtggctctaataattgttggtaaagatattgagccttctgttttcttgaggggagttggggtgcttgtttttgtacttggaaagggagactcgtatctcttgcttttttctttaattaaatttctgttttttacattaggacatgatagccatcttgcttctttctttaaaaagctgcctggaatgggagtttccagtggtagtactgcatgaagattcatgagactataaagctctttggaaaccccccaacttagcccttccaactttccttacatttttatggctttccaaaaaggttgcatgtaagggaaattatctaggtctgtgctgtttattcagcaaatagtttttgagcacctgttatgtgccaggcactgttcaaggcactagactaaactaaacttatcccaaaaaaccctctgccctcgtggagtttacgttcttatgttccagagaccctgtctg

SEQ ID NO: 300866 - DNA, 677 bp, Homo sapiens
tcctgcctcagcctcctgagtagctgggactacaggcgtgtgccaccacacccagccaatttttgtagttttagtagaaatggggtttcaccatgttggccaggatggtctcgatctcttgacctcgtgatccacctgcctcggcctcccaaagtactgggattacgcgtgagctactgcacccggctgagtgatttttttttttttttttttaagatagagaaagtccctcatactgaggagccttgcagttgagagagaacagaattccagttggaggatcaaggaatttgagggaggcagcatgcttgcagtgttcctaggatttttacaggaactacaatagaaagttagggatgaaattatattgaaaggggaaagctggactgctcaggtttggaggtcatggggaattccaggattcagtatgtggttgctctcttatttttaacttctgcttagcagtaaaaccacacccttccttcttcctgaaagtaatgtttaacttcctctccctgcagcattacactctatgtaatgggagtggggtggaggaagagtctcccaaggtggttggatctcactattctactggaagaggagcaggcaaatatatttttatgtggtataatgtcaggttgataccatctcagcagcgttgtacagcgacgcgatac

SEQ ID NO: 300867 - DNA, 781 bp, Homo sapiens
cttttgtctcatgtgttccatgatgaattaactgacttgagtaactagagtaggtcatggccaaacttaaatgttcagttctgcaccagtcagtttccttttgtcccatgttctctggaccacaacccttggccccagcagttctttccgagatatttcctctagtgtctcggtcttggtggcctcactgtggttagagaagcagccttgaataaagtgtgtgctttattcaaataaagtgaagtttgcagagggggttaggactgaagtgaacgtgcagggagacagtagggggacagcttggggaagacttccccagtgttggtttcagtaattttagcttctatgacagtgattttcctactgtcagagacagctcattaaagtgaaaattataaggaaaatgtcagtagacttagtcacatcatttcagtaaatattttttaaggatttattcaccatcccagctgctagagtgcaaagatgaatgaattaggtcttgtaggtcctgctaaggaattttgtctttattgtggggagccattgaaagttttcaaacgggtgacatgatcaactatgaagtctggcagggatgtggaagcaagataagatgtaagtgacatcttttatcatatagtccaaaacattaaataaaaataggtttaaaaatgaacactgatacaggagtctcagagaatatgctaagcataaagcataggtaacagaacatacacgctataatttcacttttgttgaaaaaaaataaactaaaagatgaaaa

SEQ ID NO: 300868 - DNA, 923 bp, Homo sapiens
agaatgcacctggcatcaacacggcggcggcggcggcggcttccaacaggctctggggcgccgagcggacaggaacgcagcacgggggctccgaggcggggtctgggtgttgaggggcgactggagccatggcggagtcggcgcctgctcgggtaaagaggcaccggcgcgctggctcgagggcgcgttggggatggcggagtcccctgccgggggcggggcttcgcggtttggacgccgccggggtcttggtttcccggggctgccgttggcgcgggtgaacgcggaccctcctcttcgcgaccccagtgctctgcccttttttccctccgcttccttctgcagcggggtcggagcctcggcgccgtgcgcccttgcccagaaacttctctgacgcttgctttagcacaggagaaaacgacgctccacacctttaacttcttccacacttccttcacaagcaacagagaaaagctcctattttcagaccaccgagatttcactctggacggtggtggccgctattcaggctgtggagaagaagatggagtcccaggctgcccggctacagagcctggaggggcgcacggggacagccgagaagaagctggctgactgcgagaagatggccgtggagttcgggaaccagctggagggcaagtgggccgtgctggggaccctgctgcaggagtatgggctactgcagaggcggctggagaacgtggagaacctgctgcgcaacaggaacttctggatcctgcggctgcccccgggcagcaagggggaggcccccaaggtgtccagtgtcattggagaaattgatggcggtctgtttccacgtagcaggactgggagaattctggacggcatggcagaatggaacctctaacagacacgttgatggacagtacactatgagaacc

SEQ ID NO: 300869 - DNA, 2814 bp, Homo sapiens
agaatgcacctggcatcaacacggcggcggcggcggcggcttccaacaggctctggggcgccgagcggacaggaacgcagcacgggggctccgaggcggggtctgggtgttgaggggcgactggagccatggcggagtcggcgcctgctcggcacaggagaaaacgacgctccacacctttaacttcttccacacttccttcacaagcaacagagaaaagctcctattttcagaccaccgagatttcactctggacggtggtggccgctattcaggctgtggagaagaagatggagtcccaggctgcccggctacagagcctggaggggcgcacggggacagccgagaagaagctggctgactgcgagaagatggccgtggagttcgggaaccagctggagggcaagtgggccgtgctggggaccctgctgcaggagtatgggctactgcagaggcggctggagaacgtggagaacctgctgcgcaacaggaacttctggatcctgcggctgcccccgggcagcaagggggaggcccccaaggtgtccaggtcactggagaatgatggcgtctgtttcaccgagcaggaatgggagaatctggaggattggcagaaggagctctacagaaacgtgatggagagtaactatgagacactggtctctctgaaggtccttggccagacagagggagaagcggagttgggtacagagatgctgggtgacttggaagaggaaggtcctggtggtgcccacccagcaggtggggtcatgatcaaacaggagctacagtatacacaggaaggccctgcggatcttcctggagagttctcatgcattgctgaagagcaggctttcctgagcccagagcagaccgaactctggggtggtcagggcagttctgtcctcttggaaacaggtcctggggactctactctagaggagcctgttggtagtagagttcctagcagcagcagaactgtgggctgcccgaagcagaaatctcataggcaggtacagctggaccaggaatgtgggcagggcctgaagctgaaaaaggacacttcccgcccctacgaatgttctgagtgtgagatcaccttccgctataagcagcagctggccacacatctgcgcagccactctgggtgggggtcttgtacacctgaggagccagaggagagccttaggcccaggccacggctgaaaccacagaccaaaaaggccaagctgcatcagtgtgatgtgtgcctgaggagcttcagctgcaaggtgagcctggtgacccatcagcgttgccacctgcaggaggggcccagtgccggccagcatgtccaagagaggttctcacccaacagcctggttgccctgcctggccacatcccttggaggaaaagccggagttccctcatctgtggttactgtggcaagagcttcagtcacccatctgacttggtgcggcaccagcgcatccacacgggtgagcggccctacagctgcactgagtgtgagaagagctttgtccagaagcagcacctcctgcagcaccagaagatccaccagcgggagcggggtgggctggccctggagcccggaaggcccaatggcctgctttaagggtgcagcccctcgcccgtctgggggatggaggggggtggcattggttcccccgaagagacactgcagtcagggactgagttcttcctgagggcagttgtttgtgattgccttcccttgtcccagtaccaagccaagcccaaaggctgtcctgaaaaccctgtggaagaagagtccaggccaggtcttcatcctgctgccaagtttgctgtttcttggcaccttcaggtctctggttttctcattcatgccaatgcttgtgggctggggttggcgttctgaccccacagggactggtggctggttccagggctcgtcccggcatttcatgtcttcccacggggttgagtcgggccataggggtgagcagctgcctggaagagttctgggaagtataaccctccattttttcttgttttataatctctttgtttaataataagtagaagaaataatttaaatgaactgcttagccctgctctgaagaaccttttttggaattagattttagttgattttttaaagaatacagcccaacacttgttttttacattttaagagttgtagaagttgttcctaacttggggactggacctaccctctaggagggagttgttaatggggctcttttagcccactgatgcttacttaggccggagagcaggggacacggtgctaggttccctcgtgcagtgcctggtgctctcaaattgtctcaaaaggaccaagaggaaaagagtcggaggggtagaccctgcagccctgttgagaagaaagattccagtgaagttgctgatggtatggctgtggtctgggacttgcggtgtctcggcatacccctctcctcttcccacctcctcctggctatgttctgcagcctcccagagtagaaaactactttgttacttaaggttgttcaccttgtaccagtggttatttgagtttgttcctattacaccaatccttacttgaggtggttcggattacagtttccaaatgcattctgggattgcctattccagagagggtacagaaaaagcacacagatggcttgtctcaggagtgttgaatgtgtgccccgctgctgtctggggggatgggagtgggctctggggtcatatgtgaacatccccttggatgatttgcggttgcttagaataaaacttgctactagcaaaagaaaaaaaaaaagttcata

SEQ ID NO: 300870 - DNA, 3274 bp, Homo sapiens
cttttgtctcatgtgttccatgatgaattaactgacttgagtaactagagtaggtcatggccaaacttaaatgttcagttctgcaccagtcagtttccttttgtcccatgttctctggaccacaacccttggccccagcagttctttccgagatatttcctctagtgtctcggtcttggtggcctcactgtggttagagaagcagccttgaataaagtgtgtgctttattcaaataaagtgaagtttgcagagggggttaggactgaagtgaacgtgcagggagacagtagggggacagcttggggaagacttccccagtgttggtttcagtaattttagcttctatgacagtgattttcctactgtcagagacagctcattaaagtgaaaattataaggaaaatgtcagtagacttagtcacatcatttcagtaaatattttttaaggatttattcaccatcccagctgctagagtgcaaagatgaatgaattaggtcttgtaggtcctgctaaggaattttgtctttattgtggggagccattgaaagttttcaaacgggtgacatgatcaactatgaagtctggcagggatgtggaagcaagataagatcacaggagaaaacgacgctccacacctttaacttcttccacacttccttcacaagcaacagagaaaagctcctattttcagaccaccgagatttcactctggacggtggtggccgctattcaggctgtggagaagaagatggagtcccaggctgcccggctacagagcctggaggggcgcacggggacagccgagaagaagctggctgactgcgagaagatggccgtggagttcgggaaccagctggagggcaagtgggccgtgctggggaccctgctgcaggagtatgggctactgcagaggcggctggagaacgtggagaacctgctgcgcaacaggaacttctggatcctgcggctgcccccgggcagcaagggggaggcccccaaggtgtccaggtcactggagaatgatggcgtctgtttcaccgagcaggaatgggagaatctggaggattggcagaaggagctctacagaaacgtgatggagagtaactatgagacactggtctctctgaaggtccttggccagacagagggagaagcggagttgggtacagagatgctgggtgacttggaagaggaaggtcctggtggtgcccacccagcaggtggggtcatgatcaaacaggagctacagtatacacaggaaggccctgcggatcttcctggagagttctcatgcattgctgaagagcaggctttcctgagcccagagcagaccgaactctggggtggtcagggcagttctgtcctcttggaaacaggtcctggggactctactctagaggagcctgttggtagtagagttcctagcagcagcagaactgtgggctgcccgaagcagaaatctcataggcaggtacagctggaccaggaatgtgggcagggcctgaagctgaaaaaggacacttcccgcccctacgaatgttctgagtgtgagatcaccttccgctataagcagcagctggccacacatctgcgcagccactctgggtgggggtcttgtacacctgaggagccagaggagagccttaggcccaggccacggctgaaaccacagaccaaaaaggccaagctgcatcagtgtgatgtgtgcctgaggagcttcagctgcaaggtgagcctggtgacccatcagcgttgccacctgcaggaggggcccagtgccggccagcatgtccaagagaggttctcacccaacagcctggttgccctgcctggccacatcccttggaggaaaagccggagttccctcatctgtggttactgtggcaagagcttcagtcacccatctgacttggtgcggcaccagcgcatccacacgggtgagcggccctacagctgcactgagtgtgagaagagctttgtccagaagcagcacctcctgcagcaccagaagatccaccagcgggagcggggtgggctggccctggagcccggaaggcccaatggcctgctttaagggtgcagcccctcgcccgtctgggggatggaggggggtggcattggttcccccgaagagacactgcagtcagggactgagttcttcctgagggcagttgtttgtgattgccttcccttgtcccagtaccaagccaagcccaaaggctgtcctgaaaaccctgtggaagaagagtccaggccaggtcttcatcctgctgccaagtttgctgtttcttggcaccttcaggtctctggttttctcattcatgccaatgcttgtgggctggggttggcgttctgaccccacagggactggtggctggttccagggctcgtcccggcatttcatgtcttcccacggggttgagtcgggccataggggtgagcagctgcctggaagagttctgggaagtataaccctccattttttcttgttttataatctctttgtttaataataagtagaagaaataatttaaatgaactgcttagccctgctctgaagaaccttttttggaattagattttagttgattttttaaagaatacagcccaacacttgttttttacattttaagagttgtagaagttgttcctaacttggggactggacctaccctctaggagggagttgttaatggggctcttttagcccactgatgcttacttaggccggagagcaggggacacggtgctaggttccctcgtgcagtgcctggtgctctcaaattgtctcaaaaggaccaagaggaaaagagtcggaggggtagaccctgcagccctgttgagaagaaagattccagtgaagttgctgatggtatggctgtggtctgggacttgcggtgtctcggcatacccctctcctcttcccacctcctcctggctatgttctgcagcctcccagagtagaaaactactttgttacttaaggttgttcaccttgtaccagtggttatttgagtttgttcctattacaccaatccttacttgaggtggttcggattacagtttccaaatgcattctgggattgcctattccagagagggtacagaaaaagcacacagatggcttgtctcaggagtgttgaatgtgtgccccgctgctgtctggggggatgggagtgggctctggggtcatatgtgaacatccccttggatgatttgcggttgcttagaataaaacttgctactagcaaaagaaaaaaaaaaagttcata

SEQ ID NO: 300871 - DNA, 3110 bp, Homo sapiens
caacctcctgggctcaaaccgtcctcccacctcagtgccccaagtacctgggactacaggcatgcatcaccatgcctggctaattttttgaacttttttgtagagacagggtttgccttgttggccaggctggtgtcaaactcctgagctaaagtgattcagctgccttggcctcccaaagtgctgggattacagttgtgagccaccacggccagccctaacagcttattgtgtgtgagaagattttgtgtaatattttctttctattcttcatcattttccaacattattaatacaatatctatgtataatttttagtatcaataaaagacatgcttttttttaattaaaagaaactagataactctgagcactgatacacttgaacactgctttctttacttgatgtttggaagtgacattgaccctgtgtctttaatccatcagccacaggagaaaacgacgctccacacctttaacttcttccacacttccttcacaagcaacagagaaaagctcctattttcagaccaccgagatttcactctggacggtggtggccgctattcaggctgtggagaagaagatggagtcccaggctgcccggctacagagcctggaggggcgcacggggacagccgagaagaagctggctgactgcgagaagatggccgtggagttcgggaaccagctggagggcaagtgggccgtgctggggaccctgctgcaggagtatgggctactgcagaggcggctggagaacgtggagaacctgctgcgcaacaggaacttctggatcctgcggctgcccccgggcagcaagggggaggcccccaaggtgtccaggtcactggagaatgatggcgtctgtttcaccgagcaggaatgggagaatctggaggattggcagaaggagctctacagaaacgtgatggagagtaactatgagacactggtctctctgaaggtccttggccagacagagggagaagcggagttgggtacagagatgctgggtgacttggaagaggaaggtcctggtggtgcccacccagcaggtggggtcatgatcaaacaggagctacagtatacacaggaaggccctgcggatcttcctggagagttctcatgcattgctgaagagcaggctttcctgagcccagagcagaccgaactctggggtggtcagggcagttctgtcctcttggaaacaggtcctggggactctactctagaggagcctgttggtagtagagttcctagcagcagcagaactgtgggctgcccgaagcagaaatctcataggcaggtacagctggaccaggaatgtgggcagggcctgaagctgaaaaaggacacttcccgcccctacgaatgttctgagtgtgagatcaccttccgctataagcagcagctggccacacatctgcgcagccactctgggtgggggtcttgtacacctgaggagccagaggagagccttaggcccaggccacggctgaaaccacagaccaaaaaggccaagctgcatcagtgtgatgtgtgcctgaggagcttcagctgcaaggtgagcctggtgacccatcagcgttgccacctgcaggaggggcccagtgccggccagcatgtccaagagaggttctcacccaacagcctggttgccctgcctggccacatcccttggaggaaaagccggagttccctcatctgtggttactgtggcaagagcttcagtcacccatctgacttggtgcggcaccagcgcatccacacgggtgagcggccctacagctgcactgagtgtgagaagagctttgtccagaagcagcacctcctgcagcaccagaagatccaccagcgggagcggggtgggctggccctggagcccggaaggcccaatggcctgctttaagggtgcagcccctcgcccgtctgggggatggaggggggtggcattggttcccccgaagagacactgcagtcagggactgagttcttcctgagggcagttgtttgtgattgccttcccttgtcccagtaccaagccaagcccaaaggctgtcctgaaaaccctgtggaagaagagtccaggccaggtcttcatcctgctgccaagtttgctgtttcttggcaccttcaggtctctggttttctcattcatgccaatgcttgtgggctggggttggcgttctgaccccacagggactggtggctggttccagggctcgtcccggcatttcatgtcttcccacggggttgagtcgggccataggggtgagcagctgcctggaagagttctgggaagtataaccctccattttttcttgttttataatctctttgtttaataataagtagaagaaataatttaaatgaactgcttagccctgctctgaagaaccttttttggaattagattttagttgattttttaaagaatacagcccaacacttgttttttacattttaagagttgtagaagttgttcctaacttggggactggacctaccctctaggagggagttgttaatggggctcttttagcccactgatgcttacttaggccggagagcaggggacacggtgctaggttccctcgtgcagtgcctggtgctctcaaattgtctcaaaaggaccaagaggaaaagagtcggaggggtagaccctgcagccctgttgagaagaaagattccagtgaagttgctgatggtatggctgtggtctgggacttgcggtgtctcggcatacccctctcctcttcccacctcctcctggctatgttctgcagcctcccagagtagaaaactactttgttacttaaggttgttcaccttgtaccagtggttatttgagtttgttcctattacaccaatccttacttgaggtggttcggattacagtttccaaatgcattctgggattgcctattccagagagggtacagaaaaagcacacagatggcttgtctcaggagtgttgaatgtgtgccccgctgctgtctggggggatgggagtgggctctggggtcatatgtgaacatccccttggatgatttgcggttgcttagaataaaacttgctactagcaaaagaaaaaaaaaaagttcata

SEQ ID NO: 300872 - DNA, 2244 bp, Homo sapiens
gggagatggaggcagagctggaggacgagaggaagcagcgctcgatggcagtggccgcccggaagaagctggagatggacctgaaggacctggaggcgcaggtccttggccagacagagggagaagcggagttgggtacagagatgctgggtgacttggaagaggaaggtcctggtggtgcccacccagcaggtggggtcatgatcaaacaggagctacagtatacacaggaaggccctgcggatcttcctggagagttctcatgcattgctgaagagcaggctttcctgagcccagagcagaccgaactctggggtggtcagggcagttctgtcctcttggaaacaggtcctggggactctactctagaggagcctgttggtagtagagttcctagcagcagcagaactgtgggctgcccgaagcagaaatctcataggcaggtacagctggaccaggaatgtgggcagggcctgaagctgaaaaaggacacttcccgcccctacgaatgttctgagtgtgagatcaccttccgctataagcagcagctggccacacatctgcgcagccactctgggtgggggtcttgtacacctgaggagccagaggagagccttaggcccaggccacggctgaaaccacagaccaaaaaggccaagctgcatcagtgtgatgtgtgcctgaggagcttcagctgcaaggtgagcctggtgacccatcagcgttgccacctgcaggaggggcccagtgccggccagcatgtccaagagaggttctcacccaacagcctggttgccctgcctggccacatcccttggaggaaaagccggagttccctcatctgtggttactgtggcaagagcttcagtcacccatctgacttggtgcggcaccagcgcatccacacgggtgagcggccctacagctgcactgagtgtgagaagagctttgtccagaagcagcacctcctgcagcaccagaagatccaccagcgggagcggggtgggctggccctggagcccggaaggcccaatggcctgctttaagggtgcagcccctcgcccgtctgggggatggaggggggtggcattggttcccccgaagagacactgcagtcagggactgagttcttcctgagggcagttgtttgtgattgccttcccttgtcccagtaccaagccaagcccaaaggctgtcctgaaaaccctgtggaagaagagtccaggccaggtcttcatcctgctgccaagtttgctgtttcttggcaccttcaggtctctggttttctcattcatgccaatgcttgtgggctggggttggcgttctgaccccacagggactggtggctggttccagggctcgtcccggcatttcatgtcttcccacggggttgagtcgggccataggggtgagcagctgcctggaagagttctgggaagtataaccctccattttttcttgttttataatctctttgtttaataataagtagaagaaataatttaaatgaactgcttagccctgctctgaagaaccttttttggaattagattttagttgattttttaaagaatacagcccaacacttgttttttacattttaagagttgtagaagttgttcctaacttggggactggacctaccctctaggagggagttgttaatggggctcttttagcccactgatgcttacttaggccggagagcaggggacacggtgctaggttccctcgtgcagtgcctggtgctctcaaattgtctcaaaaggaccaagaggaaaagagtcggaggggtagaccctgcagccctgttgagaagaaagattccagtgaagttgctgatggtatggctgtggtctgggacttgcggtgtctcggcatacccctctcctcttcccacctcctcctggctatgttctgcagcctcccagagtagaaaactactttgttacttaaggttgttcaccttgtaccagtggttatttgagtttgttcctattacaccaatccttacttgaggtggttcggattacagtttccaaatgcattctgggattgcctattccagagagggtacagaaaaagcacacagatggcttgtctcaggagtgttgaatgtgtgccccgctgctgtctggggggatgggagtgggctctggggtcatatgtgaacatccccttggatgatttgcggttgcttagaataaaacttgctactagcaaaagaaaaaaaaaaagttcata

SEQ ID NO: 300873 - DNA, 2760 bp, Homo sapiens
agaatgcacctggcatcaacacggcggcggcggcggcggcttccaacaggctctggggcgccgagcggacaggaacgcagcacgggggctccgaggcggggtctgggtgttgaggggcgactggagccatggcggagtcggcgcctgctcggcacaggagaaaacgacgctccacacctttaacttcttccacacttccttcacaagcaacagagaaaagctcctattttcagaccaccgagatttcactctggacggtggtggccgctattcaggctgtggagaagaagatggagtcccaggctgcccggctacagagcctggaggggcgcacggggacagccgagaagaagctggctgactgcgagaagatggccgtggagttcgggaaccagctggagggcaagtgggccgtgctggggaccctgctgcaggagtatgggctactgcagaggcggctggagaacgtggagaacctgctgcgcaacaggaacttctggatcctgcggctgcccccgggcagcaagggggaggcccccaaggtgtccaggtcactggagaatgatggcgtctgtttcaccgagcaggaatgggagaatctggaggattggcagaaggagctctacagaaacgtgatggagagtaactatgagacactggtctctctgaaggtccttggccagacagagggagaagcggagttgggtacagagatgctgggtgacttggaagaggaaggtcctggtggtgcccacccagcaggtggggtcatgatcaaacaggagctacagtatacacaggaaggccctgcggatcttcctggagagttctcatgcattgctgaagagcaggctttcctgagcccagagcagaccgaactctggggtggtcagggcagttctgtcctcttggaaacaggtcctggggactctactctagaggagcctgttggtagtagagttcctagcagcagcagaactgtgggctgcccgaagcagaaatctcataggcaggtacagctggaccaggaatgtgggcagggcctgaagctgaaaaaggacacttcccgcccctacgaatgttctgagtgtgagatcaccttccgctataagcagcagctggccacacatctgcgcagccactctgggtgggggtcttgtacacctgaggagccagaggagagccttaggcccaggccacggctgaaaccacagaccaaaaaggccaagctgcatcagtgtgatgtgtgcctgaggagcttcagctgcaaggtgagcctggtgacccatcagcgttgccacctgcaggaggggcccagtgccggccagcatgtccaagagaggttctcacccaacagcctggttgccctgcctggccacatcccttggaggaaaagccggagttccctcatctgtggttactgtggcaagagcttcagtcacccatctgacttggtgcggcaccagcgcatccacacgggtgagcggccctacagctgcactgagtgtgagaagagctttgtccagaagcagcacctcctgcagcaccagaagatccaccagcgggagcggggtgggctggccctggagcccggaaggcccaatggcctgctttaagggtgcagcccctcgcccgtctgggggatggaggggggtggcattggttcccccgaagagacactgcagtcagggactgagttcttcctgagggcagttgtttgtgattgccttcccttgtcccagtaccaagccaagcccaaaggctgtcctgaaaaccctgtggaagaagagtccaggccaggtcttcatcctgctgccaagtttgctgtttcttggcaccttcaggtctctggttttctcattcatgccaatgcttgtgggctggggttggcgttctgaccccacagggactggtggctggttccagggctcgtcccggcatttcatgtcttcccacggggttgagtcgggccataggggtgagcagctgcctggaagagttctgggaagtataaccctccattttttcttgttttataatctctttgtttaataataagtagaagaaataatttaaatgaactgcttagccctgctctgaagaaccttttttggaattagattttagttgattttttaaagaatacagcccaacacttgttttttacattttaagagttgtagaagttgttcctaacttggggactggacctaccctctaggagggagttgttaatggggctcttttagcccactgatgcttacttaggccggagagcaggggacacggtgctaggttccctcgtgcagtgcctggtgctctcaaattgtctcaaaaggaccaagaggaaaagagtcggaggggtagaccctgcagccctgttgagaagaaagattccagtgaagttgctgatggtatggctgtggtctgggacttgcggtgtctcggcatacccctctcctcttcccacctcctcctggctatgttctgcagcctcccagagtagtgttcctattacaccaatccttacttgaggtggttcggattacagtttccaaatgcattctgggattgcctattccagagagggtacagaaaaagcacacagatggcttgtctcaggagtgttgaatgtgtgccccgctgctgtctggggggatgggagtgggctctggggtcatatgtgaacatccccttggatgatttgcggttgcttagaataaaacttgctactagcaaaagaaaaaaaaaaagttcata

SEQ ID NO: 300874 - DNA, 897 bp, Homo sapiens
gaactatcatttacagtattgttttataagagtaatacatttatatttccaatcaacattggaaaaactgtacatgaatatagttttatagaagtcttggaacctagccagtgtcatcctcctccacgttatcctaattcacttattcctggggtgcttctgaaattcacagatgtttgtttggtcctgaagaaaccaaaggtactagaatgtgatcttttttgttggtcttcttccactttgcagcaggtggggtcatgatcaaacaggagctacagtatacacaggaaggccctgcggatcttcctggagagttctcatgcattgctgaagagcaggctttcctgagcccagagcagaccgaactctggggtggtcagggcagttctgtcctcttggaaacaggtcctggggactctactctagaggagcctgttggtagtagagttcctagcagcagcagaactgtgggctgcccgaagcagaaatctcataggcaggtacagctggaccaggaatgtgggcagggcctgaagctgaaaaaggacacttcccgcccctacgaatgttctgagtgtgagatcaccttccgctataagcagcagctggccacacatctgcgcagccactctgggtgggggtcttgtacacctgaggagccagaggagagccttaggcccaggccacggctgaaaccacagaccaaaaaggccaagctgcatcagtgtgatgtgtgcctgaggagcttcagctgcaaggtgagcctggtgacccatcagcgttgccacctgcaggaggggcccagtgccggccagcatgtccaagagaggttctcacccaacagcctggttgccctgcctggccacatcccttggaggaaaagccggagttccctca

SEQ ID NO: 300875 - DNA, 1330 bp, Homo sapiens
ttctcttcattaaatagtatttaacaaacatttaaggaccttctattggctagctaacacttgcatggaactctctcactatgttgcccaaactggccttgaactcctaggctcaagcaatcctcctaagcatcaaggactacaggtgcatgctagctaccacacccagctgtaatcaccttttgattttgtctgctagtgccagaggcatatgcataatgtgaattcatcaaactgcaaataaaaatgtttgagtccttttttaatatgtggatctctctggtactgtttttagataaataaaagagtagcctagaagaatacataaatcaaaaactgaccaattcagaattaaatgagatagtcccagcttgaattaataccagtctttaaaaaaataaatgtgagtttttacttttaattataaaaggtaatctaaattaccttaaactaaggtaattgccaagaccagttatggtagatttacttttataaatataataattgtaaaataaatattgtttataagcaaatagatgcagctaaagtcctttttaaaggctcacagaaagctttccaaagatgattaaatattctctaaaatactatttgtttagcacaccatttattttgaaaaacaggacaaaagaaaactcaatcagcccgtgtttgattcactttgaatttcaaattgaagaattccaaataaaactttattacctctcagtttaactatggtttgtctaatagttcattttaggacaaaatggggagtaaacttctccaactctgaggtgaaatacaccatcttcatgaccaaacacggtgaatcacgttgccatttttcattcttcacatctctcctgtcttaacctcctttccacttccagctgtgcttggtttttgtgtatttttgtaataggatgaatgttgttttcattttctttctcagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttagaatggtgatagcaataccttcttcttgcatatggtaatacttttaaaagttgaattgttttatttatttgtatattttgtaaagaataaagttattgaaagaaatgta

SEQ ID NO: 300876 - DNA, 1637 bp, Homo sapiens
ttctcttcattaaatagtatttaacaaacatttaaggaccttctattggctagctaacacttgcatggaactctctcactatgttgcccaaactggccttgaactcctaggctcaagcaatcctcctaagcatcaaggactacaggtgcatgctagctaccacacccagctgtaatcaccttttgattttgtctgctagtgccagaggcatatgcataatgtgaattcatcaaactgcaaataaaaatgtttgagtccttttttaatatgtggatctctctggtactgtttttagataaataaaagagtagcctagaagaatacataaatcaaaaactgaccaattcagaattaaatgagatagtcccagcttgaattaataccagtctttaaaaaaataaatgtgagtttttacttttaattataaaaggtaatctaaattaccttaaactaaggtaattgccaagaccagttatggtagatttacttttataaatataataattgtaaaataaatattgtttataagcaaatagatgcagctaaagtcctttttaaaggctcacagaaagctttccaaagatgattaaatattctctaaaatactatttgtttagcacaccatttattttgaaaaacaggacaaaagaaaactcaatcagcccgtgtttgattcactttgaatttcaaattgaagaattccaaataaaactttattacctctcagtttaactatggtttgtctaatagttcattttaggacaaaatggggagtaaacttctccaactctgaggtgaaatacaccatcttcatgaccaaacacggtgaatcacgttgccatttttcattcttcacatctctcctgtcttaacctcctttccacttccagctgtgcttggtttttgtgtatttttgtaataggatgaatgttgttttcattttctttctcagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccacttacacattcaataaatgtttagtagttctgaaaaaaagctcttctatataatgttaatggtttcttggtgaggtagtctctcttgttgactcagtattttgctatgaaaatatacacaagttttctggatctggatttaaattcttaaaggatagcagaggctatgtcctcttaactttccagttctaatattccttttactgtaataaccacagaagttctttctcacatttctggtaacctacctatcccaatccctatacaaactctctaaattggttggtttattatagactttgtttttcattgcccctcactcccagcctggaggaacctatagatcatttattctacctcttcattgtagacataaggaaacagtaccagagtttttatcaaagtaaagttttctaaacctggagtccccacagatagataaagcatatatggatagacttcttgta

SEQ ID NO: 300877 - DNA, 8926 bp, Homo sapiens
taaatttaaaggcggggcggcctgtgagccctgaagtgccggccgcggagggtcctggccattttggtgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagtttcctgatagggaatttctcttacgtgtatcttacatggaaatatacaatgaaaccattacagatttactctgtggcactcaaaaaatgaaacctttaattattcgagaagatgtcaataggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaaggatctgttaaggtatcccatttgaatttggttgatcttgcaggcagtgaaagagctgctcaaacaggcgctgcaggtgtgcggctcaaggaaggctgtaatataaatcgaagcttatttattttgggacaagtgatcaagaaacttagtgatggacaagttggtggtttcataaattatcgagatagcaagttaacacgaattctccagaattccttgggaggaaatgcaaagacacgtattatctgcacaattactccagtatcttttgatgaaacacttactgctctccagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagagatgcaactaattcatgaaatttcgaacttaaagaatttagttaagcatcgagaagtatataatcaagatcttgagaatgaactcagttcaaaagtagagctgcttagagaaaaggaagaccagattaagaagctacaggaatacatagactctcaaaagctagaaaatataaaaatggacttgtcatactcattggaaagcattgaagacccaaaacaaatgaagcagactctgtttgatgctgaaactgtagcccttgatgccaagagagaatcagcctttcttagaagtgaaaatctggagttgaaggagaaaatgaaagaacttgcaactacatacaagcaaatggaaaatgatattcagttatatcaaagccaattggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctccgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacaggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagagatcccagtgcttcatgaggaacaagagttactgcctaatgtgaaaaaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaaatccaggagtctcaaagcaaacaagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaacacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaatttaatataaaacaaattagtgaggttcaggaaaaagtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcagaaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaagatccaagaacttcagaaaaaagaacttcaactgcttagagtgaaagaagatgtcaatatgagtcataaaaaaattaatgaaatggaacagttgaagaagcaatttgagccaaactatctatgcaagtgtgagatggataacttccagttgactaagaaacttcatgaaagccttgaagaaataagaattgtagctaaagaaagagatgagctaaggaggataaaagaatctctcaaaatggaaagggaccaattcatagcaaccttaagggaaatgatagctagagaccgacagaaccaccaagtaaaacctgaaaaaaggttactaagtgatggacaacagcaccttatggaaagcctgagagaaaagtgctctagaataaaagagcttttgaagagatactcagagatggatgatcattatgagtgcttgaatagattgtctcttgacttggagaaggaaattgaattccaaaaagagctttcaatgaaacaagtatgtgttaagctatgttacaaaaataaaagaagaacaacatgaatgcatcaataaatttgaaatggattttattgatgaagtggaaaagcaaaaggaattgctaattaaaatacagcaccttcaacaagattgtgatgtaccatccagagaattaagggatctcaaattgaaccagaatatggatctacatattgaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggacaaagttgctttaggagctaagccatataaagaagaaattgaagatctcaaaatgaagcttgtgaaaatagacctagagaaaatgaaaaatgccaaagaatttgaaaaggaaatcagtgctacaaaagccactgtagaatatcaaaaggaagttataaggctattgagagaaaatctcagaagaagtcaacaggcccaagatacctcagtgatatcagaacatactgatcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaacaaaagaatgaattgttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttagaatggtgatagcaataccttcttcttgcatatggtaatacttttaaaagttgaattgttttatttatttgtatattttgtaaagaataaagttattgaaagaaatgtaaagttatctacatgacttagcatattccaaagcataatacatacattaatataaaacatcattttattaacaaaattgtaaatgtttttaataccttacacattcaataaatgtttagtagttctgaaaaaaagctcttctatataatgttaatggtttcttggtgaggtagtctctcttgttgactcagtattttgctatgaaaatatacacaagttttctggatctggatttaaattcttaaaggatagcagaggctatgtcctcttaactttccagttctaatattccttttactgtaataaccacagaagttctttctcacatttctggtaacctacctatcccaatccctatacaaactctctaaattggttggtttattatagactttgtttttcattgcccctcactcccagcctggaggaacctatagatcatttattctacctcttcattgtagacataaggaaacagtaccagagtttttatcaaagtaaagttttctaaacctggagtccccacagatagataaagcatatatggatagacttcttgta

SEQ ID NO: 300878 - DNA, 8366 bp, Homo sapiens
taaatttaaaggcggggcggcctgtgagccctgaagtgccggccgcggagggtcctggccattttggtgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagtttcctgatagggaatttctcttacgtgtatcttacatggaaatatacaatgaaaccattacagatttactctgtggcactcaaaaaatgaaacctttaattattcgagaagatgtcaataggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaaggatctgttaaggtatcccatttgaatttggttgatcttgcaggcagtgaaagagctgctcaaacaggcgctgcaggtgtgcggctcaaggaaggctgtaatataaatcgaagcttatttattttgggacaagtgatcaagaaacttagtgatggacaagttggtggtttcataaattatcgagatagcaagttaacacgaattctccagaattccttgggaggaaatgcaaagacacgtattatctgcacaattactccagtatcttttgatgaaacacttactgctctccagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagagatgcaactaattcatgaaatttcgaacttaaagaatttagttaagcatcgagaagtatataatcaagatcttgagaatgaactcagttcaaaagtagagctgcttagagaaaaggaagaccagattaagaagctacaggaatacatagactctcaaaagctagaaaatataaaaatggacttgtcatactcattggaaagcattgaagacccaaaacaaatgaagcagactctgtttgatgctgaaactgtagcccttgatgccaagagagaatcagcctttcttagaagtgaaaatctggagttgaaggagaaaatgaaagaacttgcaactacatacaagcaaatggaaaatgatattcagttatatcaaagccaattggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctccgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacaggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagagatcccagtgcttcatgaggaacaagagttactgcctaatgtgaaaaaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaaatccaggagtctcaaagcaaacaagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaacacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaatttaatataaaacaaattagtgaggttcaggaaaaagtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcagaaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaagatccaagaacttcagaaaaaagaacttcaactgcttagagtgaaagaagatgtcaatatgagtcataaaaaaattaatgaaatggaacagttgaagaagcaatttgagccaaactatctatgcaagtgtgagatggataacttccagttgactaagaaacttcatgaaagccttgaagaaataagaattgtagctaaagaaagagatgagctaaggaggataaaagaatctctcaaaatggaaagggaccaattcatagcaaccttaagggaaatgatagctagagaccgacagaaccaccaagtaaaacctgaaaaaaggttactaagtgatggacaacagcaccttatggaaagcctgagagaaaagtgctctagaataaaagagcttttgaagagatactcagagatggatgatcattatgagtgcttgaatagattgtctcttgacttggagaaggaaattgaattccaaaaagagctttcaatgaaacaagtatgtgttaagctatgttacaaaaataaaagaagaacaacatgaatgcatcaataaatttgaaatggattttattgatgaagtggaaaagcaaaaggaattgctaattaaaatacagcaccttcaacaagattgtgatgtaccatccagagaattaagggatctcaaattgaaccagaatatggatctacatattgaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggacaaagttgctttaggagctaagccatataaagaagaaattgaagatctcaaaatgaagcttgtgaaaatagacctagagaaaatgaaaaatgccaaagaatttgaaaaggaaatcagtgctacaaaagccactgtagaatatcaaaaggaagttataaggctattgagagaaaatctcagaagaagtcaacaggcccaagatacctcagtgatatcagaacatactgatcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaacaaaagaatgaattgttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttagaatggtgatagcaataccttcttcttgcatatggtaatacttttaaaagttgaattgttttatttatttgtatattttgtaaagaataaagttattgaaagaaatgta

SEQ ID NO: 300879 - DNA, 8623 bp, Homo sapiens
taaatttaaaggcggggcggcctgtgagccctgaagtgccggccgcggagggtcctggccattttggtgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagtttcctgatagggaatttctcttacgtgtatcttacatggaaatatacaatgaaaccattacagatttactctgtggcactcaaaaaatgaaacctttaattattcgagaagatgtcaataggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaaggatctgttaaggtatcccatttgaatttggttgatcttgcaggcagtgaaagagctgctcaaacaggcgctgcaggtgtgcggctcaaggaaggctgtaatataaatcgaagcttatttattttgggacaagtgatcaagaaacttagtgatggacaagttggtggtttcataaattatcgagatagcaagttaacacgaattctccagaattccttgggaggaaatgcaaagacacgtattatctgcacaattactccagtatcttttgatgaaacacttactgctctccagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagagaatgaactcagttcaaaagtagagctgcttagagaaaaggaagaccagattaagaagctacaggaatacatagactctcaaaagctagaaaatataaaaatggacttgtcatactcattggaaagcattgaagacccaaaacaaatgaagcagactctgtttgatgctgaaactgtagcccttgatgccaagagagaatcagcctttcttagaagtgaaaatctggagttgaaggagaaaatgaaagaacttgcaactacatacaagcaaatggaaaatgatattcagttatatcaaagccaattggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctccgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacaggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagagatcccagtgcttcatgaggaacaagagttactgcctaatgtgaaaaaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaaatccaggagtctcaaagcaaacaagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaacacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaatttaatataaaacaaattagtgaggttcaggaaaaagtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcagaaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaaggaccgacagaaccaccaagtaaaacctgaaaaaaggttactaagtgatggacaacagcaccttatggaaagcctgagagaaaagtgctctagaataaaagagcttttgaagagatactcagagatggatgatcattatgagtgcttgaatagattgtctcttgacttggagaaggaaattgaattccaaaaagagctttcaatgaaagttaaagcaaacctctcacttccctatttacaaaccaaacacattgaaaaactttttactgcaaaccagagatgctccatggaattccacagaatcatgaagaaactgaagcaagtatgtgttaagctatgttacaaaaataatggaaaagcaaaaggaattgctaattaaaatacagcaccttcaacaagattgtgatgtaccatccagagaattaagggatctcaaattgaaccagaatatggatctacatattgaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggacaaagttgctttaggagctaagccatataaagaagaaattgaagatctcaaaatgaagcttgtgaaaatagacctagagaaaatgaaaaatgccaaagaatttgaaaaggaaatcagtgctacaaaagccactgtagaatatcaaaaggaagttataaggctattgagagaaaatctcagaagaagtcaacaggcccaagatacctcagtgatatcagaacatactgatcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaacaaaagaatgaattgttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttagaatggtgatagcaataccttcttcttgcatatggtaatacttttaaaagttgaattgttttatttatttgtatattttgtaaagaataaagttattgaaagaaatgtaaagttatctacatgacttagcatattccaaagcataatacatacattaatataaaacatcattttattaacaaaattgtaaatgtttttaataccttacacattcaataaatgtttagtagttctgaaaaaaagctcttctatataatgttaatggtttcttggtgaggtagtctctcttgttgactcagtattttgctatgaaaatatacacaagttttctggatctggatttaaattcttaaaggatagcagaggctatgtcctcttaactttccagttctaatattccttttactgtaataaccacagaagttctttctcacatttctggtaacctacctatcccaatccctatacaaactctctaaattggttggtttattatagactttgtttttcattgcccctcactcccagcctggaggaacctatagatcatttattctacctcttcattgtagacataaggaaacagtaccagagtttttatcaaagtaaagttttctaaacctggagtccccacagatagataaagcatatatggatagacttcttgta

SEQ ID NO: 300880 - DNA, 4295 bp, Homo sapiens
atattattataaaccctaaatatttggaaaggggagttaattacaacaaaatagttataatgtttctataaatttattggaatttcctctaataataaagcacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaatttaatataaaacaaattagtgaggttcaggaaaaagtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcagaaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaaggaccgacagaaccaccaagtaaaacctgaaaaaaggttactaagtgatggacaacagcaccttatggaaagcctgagagaaaagtgctctagaataaaagagcttttgaagagatactcagagatggatgatcattatgagtgcttgaatagattgtctcttgacttggagaaggaaattgaattccaaaaagagctttcaatgaaagttaaagcaaacctctcacttccctatttacaaaccaaacacattgaaaaactttttactgcaaaccagagatgctccatggaattccacagaatcatgaagaaactgaagcaagtatgtgttaagctatgttacaaaaataatggaaaagcaaaaggaattgctaattaaaatacagcaccttcaacaagattgtgatgtaccatccagagaattaagggatctcaaattgaaccagaatatggatctacatattgaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggacaaagttgctttaggagctaagccatataaagaagaaattgaagatctcaaaatgaagcttgtgaaaatagacctagagaaaatgaaaaatgccaaagaatttgaaaaggaaatcagtgctacaaaagccactgtagaatatcaaaaggaagttataaggctattgagagaaaatctcagaagaagtcaacaggcccaagatacctcagtgatatcagaacatactgatcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaacaaaagaatgaattgttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttagaatggtgatagcaataccttcttcttgcatatggtaatacttttaaaagttgaattgttttatttatttgtatattttgtaaagaataaagttattgaaagaaatgtaaagttatctacatgacttagcatattccaaagcataatacatacattaatataaaacatcattttattaacaaaattgtaaatgtttttaataccttacacattcaataaatgtttagtagttctgaaaaaaagctcttctatataatgttaatggtttcttggtgaggtagtctctcttgttgactcagtattttgctatgaaaatatacacaagttttctggatctggatttaaattcttaaaggatagcagaggctatgtcctcttaactttccagttctaatattccttttactgtaataaccacagaagttctttctcacatttctggtaacctacctatcccaatccctatacaaactctctaaattggttggtttattatagactttgtttttcattgcccctcactcccagcctggaggaacctatagatcatttattctacctcttcattgtagacataaggaaacagtaccagagtttttatcaaagtaaagttttctaaacctggagtccccacagatagataaagcatatatggatagacttcttgta

SEQ ID NO: 300881 - DNA, 7327 bp, Homo sapiens
taaatttaaaggcggggcggcctgtgagccctgaagtgccggccgcggagggtcctggccattttggtgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagtttcctgatagggaatttctcttacgtgtatcttacatggaaatatacaatgaaaccattacagatttactctgtggcactcaaaaaatgaaacctttaattattcgagaagatgtcaataggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaaggatctgttaaggtatcccatttgaatttggttgatcttgcaggcagtgaaagagctgctcaaacaggcgctgcaggtgtgcggctcaaggaaggctgtaatataaatcgaagcttatttattttgggacaagtgatcaagaaacttagtgatggacaagttggtggtttcataaattatcgagatagcaagttaacacgaattctccagaattccttgggaggaaatgcaaagacacgtattatctgcacaattactccagtatcttttgatgaaacacttactgctctccagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagagaatgaactcagttcaaaagtagagctgcttagagaaaaggaagaccagattaagaagctacaggaatacatagactctcaaaagctagaaaatataaaaatggacttgtcatactcattggaaagcattgaagacccaaaacaaatgaagcagactctgtttgatgctgaaactgtagcccttgatgccaagagagaatcagcctttcttagaagtgaaaatctggagttgaaggagaaaatgaaagaacttgcaactacatacaagcaaatggaaaatgatattcagttatatcaaagccaattggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctccgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacaggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagagatcccagtgcttcatgaggaacaagagttactgcctaatgtgaaaaaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaaatccaggagtctcaaagcaaacaagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaacacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaatttaatataaaacaaattagtgaggttcaggaaaaagtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcagaaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaaggaccgacagaaccaccaagtaaaacctgaaaaaaggttactaagtgatggacaacagcaccttatggaaagcctgagagaaaagtgctctagaataaaagagcttttgaagagatactcagagatggatgatcattatgagtgcttgaatagattgtctcttgacttggagaaggaaattgaattccaaaaagagctttcaatgaaagttaaagcaaacctctcacttccctatttacaaaccaaacacattgaaaaactttttactgcaaaccagagatgctccatggaattccacagaatcatgaagaaactgaagcaagtatgtgttaagctatgttacaaaaataatggaaaagcaaaaggaattgctaattaaaatacagcaccttcaacaagattgtgatgtaccatccagagaattaagggatctcaaattgaaccagaatatggatctacatattgaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggacaaagttgctttaggagctaagccatataaagaagaaattgaagatctcaaaatgaagcttgtgaaaatagacctagagaaaatgaaaaatgccaaagaatttgaaaaggagtacgtatttgtcttaatttaatgtgattttaatagcttaaattttcttcctaaactacatatacttttcattagttaactttttaaaatataatttatgaaaatattgttacagctctttttttaaaaatgtacacatccatagattttaaatatactggtctcattacatatgcaaagtttttaaaactaaacacaattctgatcaatt

SEQ ID NO: 300882 - DNA, 1890 bp, Homo sapiens
ttctcttcattaaatagtatttaacaaacatttaaggaccttctattggctagctaacacttgcatggaactctctcactatgttgcccaaactggccttgaactcctaggctcaagcaatcctcctaagcatcaaggactacaggtgcatgctagctaccacacccagctgtaatcaccttttgattttgtctgctagtgccagaggcatatgcataatgtgaattcatcaaactgcaaataaaaatgtttgagtccttttttaatatgtggatctctctggtactgtttttagataaataaaagagtagcctagaagaatacataaatcaaaaactgaccaattcagaattaaatgagatagtcccagcttgaattaataccagtctttaaaaaaataaatgtgagtttttacttttaattataaaaggtaatctaaattaccttaaactaaggtaattgccaagaccagttatggtagatttacttttataaatataataattgtaaaataaatattgtttataagcaaatagatgcagctaaagtcctttttaaaggctcacagaaagctttccaaagatgattaaatattctctaaaatactatttgtttagcacaccatttattttgaaaaacaggacaaaagaaaactcaatcagcccgtgtttgattcactttgaatttcaaattgaagaattccaaataaaactttattacctctcagtttaactatggtttgtctaatagttcattttaggacaaaatggggagtaaacttctccaactctgaggtgaaatacaccatcttcatgaccaaacacggtgaatcacgttgccatttttcattcttcacatctctcctgtcttaacctcctttccacttccagctgtgcttggtttttgtgtatttttgtaataggatgaatgttgttttcattttctttctcagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttagaatggtgatagcaataccttcttcttgcatatggtaatacttttaaaagttgaattgttttatttatttgtatattttgtaaagaataaagttattgaaagaaatgtaaagttatctacatgacttagcatattccaaagcataatacatacattaatataaaacatcattttattaacaaaattgtaaatgtttttaataccttacacattcaataaatgtttagtagttctgaaaaaaagctcttctatataatgttaatggtttcttggtgaggtagtctctcttgttgactcagtattttgctatgaaaatatacacaagttttctggatctggatttaaattcttaaaggatagcagaggctatgtcctcttaactttccagttctaatattccttttactgtaataaccacagaagttctttctcacatttctggtaacctacctatcccaatccctatacaaactctctaaattggttggtttattatagactttgtttttcattgcccctcactcccagcctggaggaacctatagatcatttattctacctcttcattgtagacataaggaaacagtaccagagtttttatcaaagtaaagttttctaaacctggagtccccacagatagataaagcatatatggatagacttcttgta

SEQ ID NO: 300883 - DNA, 529 bp, Homo sapiens
cttaaaaatggcatccagaaagaaaatgataggatttgtcaagtgaataacttctttaataacagaataattgtaagtattactttttgctgtactacttttttgttgctgtttgctttaattgtcctacctcattcttaaaagggcaacttatgtatattttctttatttgtatatgctttaaaaaaattgatttgataaaacgtgttcttcctctaatgtattattcttccttatcaattcatactgatcaaggtaacgaaatcttgttgtataatatttagtttccacttgtgaaatcttgaatcctcttactattgtcctctttttcttctccttctcactgcttctgtaagaactgagccttttccacgagtagccttagagatcgtaagacatgagtctgtttcaagctatgggcagcaactgtggtaaagtcatagacaagcctggccagctactttagatgggcctcatgtgctttaataaacttttttttttaagagcagttttaggttcacagcaaaat

SEQ ID NO: 300884 - DNA, 256 bp, Homo sapiens
aaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggtaacttaaacataaaaataaaagttgtttgtttgtttgtttgtttaacctattgaattcagcaaatctc

SEQ ID NO: 300885 - DNA, 401 bp, Homo sapiens
ttcttccatatattcaaaaacttacacatatgattataatctactgaatttactttctgttttaaatattttttagttagtagttttaatctgcctcatataacttgtaaactaatttttgaaactctggctgatttaagagttctgcattaaaaaccaactactttattatataaacgttctcaatctttttctcctgtaaacttattccttgctaagtggtttcataaattatcgagatagcaagttaacacgaattctccagaattccttgggaggaaatgcaaagacacgtattatctgcacaattactccagtatcttttgatgaaacacttactgctctccaggtgagtttgatttttatctcagcttaatataggggaagatcagcttgaagaa

SEQ ID NO: 300886 - DNA, 2667 bp, Homo sapiens
  misc_feature (1546)..(1546): n is a, c, g, or t
cggcggcgagccagggagaaaggatggccggcctggcggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcgcctgggtgtccctcaatgcatggttctggtccacagttttccacaccagggacactgacctcacagagaaaatggactacttctgtgcctccactgtcatcctacactcaatctacctgtgctgcgtcaggaccgtggggctgcagcacccagctgtggtcagtgccttccgggctctcctgctgctcatgctgaccgtgcacgtctcctacctgagcctcatccgcttcgactatggctacaacctggtggccaacgtggctattggcctggtcaacgtggtgtggtggctggcctggtgcctgtggaaccagcggcggctgcctcacgtgcgcaagtgcgtggtggtggtcttgctgctgcaggggctgtccctgctcgagctgcttgacttcccaccgctcttctgggtcctggatgcccatgccatctggcacatcagcaccatccctgtccacgtcctctttttcagctttctggaagatgacagcctgtacctgctgaaggaatcagaggacaagttcaagctggactgaagaccttggagcgagtctgccccagtggggatcctgcccccgccctgctggcctcccttctcccctcaacccttgagatgattttctcttttcaacttcttgaacttggacatgaaggatgtgggcccagaatcatgtggccagcccaccccctgttggccctcaccagccttggagtctgttctagggaaggcctcccagcatctgggactcgagagtgggcagcccctctacctcctggagctgaactggggtggaactgagtgtgctcttagctctaccgggaggacagctgcctgtttcctccccaccagcctcctccccacatccccagctgcctggctgggtcctgaagccctctgtctacctgggagaccagggaccacaggccttagggatacagggggtccccttctgttaccaccccccaccctcctccaggacaccactaggtggtgctggatgcttgttctttggccagccaaggttcacggcgattctccccatgggatcttgagggaccaagctgctgggattgggaaggagtttcaccctgaccnttgccctagccaggttcccaggaggcctcaccatactccctttcagggccagggctccagcaagcccagggcaaggatcctgtgctgctgtctggttgagagcctgccaccgtgtgtcgggagtgtgggccaggctgagtgcataggtgacagggccgtgagcatgggcctgggtgtgtgtgagctcaggcctaggtgcgcagtgtggagacgggtgttgtcggggaagaggtgtggcttcaaagtgtgtgtgtgcagggggtgggtgtgttagcgtgggttaggggaacgtgtgtgcgcgtgctggtgggcatgtgagatgagtgactgccggtgaatgtgtccacagttgagaggttggagcaggatgagggaatcctgtcaccatcaataatcacttgtggagcgccagctctgcccaagacgccacctgggcggacagccaggagctctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgttccagggtggccccagggcaggcaggggccacactatgcctgcgccctggtaaaggtgacccctgccatttaccagcagccctggcatgttcctgccccacaggaatagaatggagggagctccagaaactttccatcccaaaggcagtctccgtggttgaagcagactggatttttgctctgcccctgaccccttgtccctctttgagggaggggagctatgctaggactccaacctcagggactcgggtggcctgcgctagcttcttttgatactgaaaacttttaaggtgggagggtggcaagggatgtgcttaataaatcaattccaagcctca

SEQ ID NO: 300887 - DNA, 602 bp, Homo sapiens
  misc_feature (586)..(586): n is a, c, g, or t
cggcggcgagccagggagaaaggatggccggcctggcggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcgcctgggtgtccctcaatgcatggttctggtccacagttttccacaccagggacactgacctcacagagaaaatttactacttcttttcctccactttcatcctacactcaatctaccttttcttcttcattacctnttttcttcatcaccca

SEQ ID NO: 300888 - DNA, 840 bp, Homo sapiens
cggcggcgagccagggagaaaggatggccggcctggcggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcgcctggatgagaaaactgaggcacagcaaggctaaataacttgcccaaggacacacaggaaatgcagagccaggaactgaaccctggcagtctggctgtagggcttgcattcttaatgataccactacctcccaaatctgaggaaagggtgtccctcaatgcatggttctggtccacagttttccacaccagggacactgacctcacagagaaaatggactacttctgtgcctccactgtcatcctacactcaatctacctgtgctgcgtcaggtgagcctgcctgggtggctgcaggggcaaaatcgaaccctgggggcagaaaggggtcacccagccttcccctgggggccttcttcactagtctcccaacacctacgccccccaaccc

SEQ ID NO: 300889 - DNA, 461 bp, Homo sapiens
acttgtggagcgccagctctgcccaagacgccacctgggcggacagccaggagctctccatggccaggctgcctcacgtgcgcaagtgcgtggtggtggtcttgctgctgcaggggctgtccctgctcgagctgcttgacttcccaccgctcttctgggtcctggatgcccatgccatctggcacatcagcaccatccctgtccacgtcctctttttcagctttctggaagatgacagcctgtacctgctgaaggaatcagaggacaagttcaagcgtggttgaagcagactggatttttgctctgcccctgaccccttgtccctctttgagggaggggagctatgctaggactccaacctcagggactcgggtggcctgcgctagcttcttttgatactgaaaacttttaaggtgggagggtggcaagggatgtgcttaataaatcaattccaagcctca

SEQ ID NO: 300890 - DNA, 2530 bp, Homo sapiens
  misc_feature (1409)..(1409): n is a, c, g, or t
cggcggcgagccagggagaaaggatggccggcctggcggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcgcctgggtgtccctcaatgcatggttctggtccacagttttccacaccagggacactgacctcacagagaaaatggactacttctgtgcctccactgtcatcctacactcaatctacctgtgctgcgtcaggcctggtcaacgtggtgtggtggctggcctggtgcctgtggaaccagcggcggctgcctcacgtgcgcaagtgcgtggtggtggtcttgctgctgcaggggctgtccctgctcgagctgcttgacttcccaccgctcttctgggtcctggatgcccatgccatctggcacatcagcaccatccctgtccacgtcctctttttcagctttctggaagatgacagcctgtacctgctgaaggaatcagaggacaagttcaagctggactgaagaccttggagcgagtctgccccagtggggatcctgcccccgccctgctggcctcccttctcccctcaacccttgagatgattttctcttttcaacttcttgaacttggacatgaaggatgtgggcccagaatcatgtggccagcccaccccctgttggccctcaccagccttggagtctgttctagggaaggcctcccagcatctgggactcgagagtgggcagcccctctacctcctggagctgaactggggtggaactgagtgtgctcttagctctaccgggaggacagctgcctgtttcctccccaccagcctcctccccacatccccagctgcctggctgggtcctgaagccctctgtctacctgggagaccagggaccacaggccttagggatacagggggtccccttctgttaccaccccccaccctcctccaggacaccactaggtggtgctggatgcttgttctttggccagccaaggttcacggcgattctccccatgggatcttgagggaccaagctgctgggattgggaaggagtttcaccctgaccnttgccctagccaggttcccaggaggcctcaccatactccctttcagggccagggctccagcaagcccagggcaaggatcctgtgctgctgtctggttgagagcctgccaccgtgtgtcgggagtgtgggccaggctgagtgcataggtgacagggccgtgagcatgggcctgggtgtgtgtgagctcaggcctaggtgcgcagtgtggagacgggtgttgtcggggaagaggtgtggcttcaaagtgtgtgtgtgcagggggtgggtgtgttagcgtgggttaggggaacgtgtgtgcgcgtgctggtgggcatgtgagatgagtgactgccggtgaatgtgtccacagttgagaggttggagcaggatgagggaatcctgtcaccatcaataatcacttgtggagcgccagctctgcccaagacgccacctgggcggacagccaggagctctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgttccagggtggccccagggcaggcaggggccacactatgcctgcgccctggtaaaggtgacccctgccatttaccagcagccctggcatgttcctgccccacaggaatagaatggagggagctccagaaactttccatcccaaaggcagtctccgtggttgaagcagactggatttttgctctgcccctgaccccttgtccctctttgagggaggggagctatgctaggactccaacctcagggactcgggtggcctgcgctagcttcttttgatactgaaaacttttaaggtgggagggtggcaagggatgtgcttaataaatcaattccaagcctca

SEQ ID NO: 300891 - DNA, 2325 bp, Homo sapiens
  misc_feature (1204)..(1204): n is a, c, g, or t
cggcggcgagccagggagaaaggatggccggcctggcggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcgcctgggtgtccctcaatgcatggttctggtccacagttttccacaccagggacactgacctcacagagaaaatggactacttctgtgcctccactgtcatcctacactcaatctacctgtgctgcgtcagctttctggaagatgacagcctgtacctgctgaaggaatcagaggacaagttcaagctggactgaagaccttggagcgagtctgccccagtggggatcctgcccccgccctgctggcctcccttctcccctcaacccttgagatgattttctcttttcaacttcttgaacttggacatgaaggatgtgggcccagaatcatgtggccagcccaccccctgttggccctcaccagccttggagtctgttctagggaaggcctcccagcatctgggactcgagagtgggcagcccctctacctcctggagctgaactggggtggaactgagtgtgctcttagctctaccgggaggacagctgcctgtttcctccccaccagcctcctccccacatccccagctgcctggctgggtcctgaagccctctgtctacctgggagaccagggaccacaggccttagggatacagggggtccccttctgttaccaccccccaccctcctccaggacaccactaggtggtgctggatgcttgttctttggccagccaaggttcacggcgattctccccatgggatcttgagggaccaagctgctgggattgggaaggagtttcaccctgaccnttgccctagccaggttcccaggaggcctcaccatactccctttcagggccagggctccagcaagcccagggcaaggatcctgtgctgctgtctggttgagagcctgccaccgtgtgtcgggagtgtgggccaggctgagtgcataggtgacagggccgtgagcatgggcctgggtgtgtgtgagctcaggcctaggtgcgcagtgtggagacgggtgttgtcggggaagaggtgtggcttcaaagtgtgtgtgtgcagggggtgggtgtgttagcgtgggttaggggaacgtgtgtgcgcgtgctggtgggcatgtgagatgagtgactgccggtgaatgtgtccacagttgagaggttggagcaggatgagggaatcctgtcaccatcaataatcacttgtggagcgccagctctgcccaagacgccacctgggcggacagccaggagctctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgttccagggtggccccagggcaggcaggggccacactatgcctgcgccctggtaaaggtgacccctgccatttaccagcagccctggcatgttcctgccccacaggaatagaatggagggagctccagaaactttccatcccaaaggcagtctccgtggttgaagcagactggatttttgctctgcccctgaccccttgtccctctttgagggaggggagctatgctaggactccaacctcagggactcgggtggcctgcgctagcttcttttgatactgaaaacttttaaggtgggagggtggcaagggatgtgcttaataaatcaattccaagcctca

SEQ ID NO: 300892 - DNA, 2306 bp, Homo sapiens
  misc_feature (1185)..(1185): n is a, c, g, or t
acatcagctgtcctgggtgaggactctggggtaggactgggggccctggctcctgacaaggagctgtagcacttgctgcccagctgtggcctgtttggtggggagaggggtagtgacttcaggggccatgcaccaatgttggggggaggagatgcttcagggaatgctgctctggggatgggccacctgccctctgagcaaccctggacggtggggcaggaccgtggggctgcagcacccagctgtggtcagtgccttccgggctctcctgctgctcatgctgaccgtgcacgtctcctacctgagcctcatccgcttcgactatggctacaacctggtggccaacgtggctattggcctggtcaacgtggtgtggtggctggcctggtgcctgtggaaccagcggcggctgcctcacgtgcgcaagtgcgtggtggtggtcttgctgctgcaggggctgtccctgctcgagctgcttgacttcccaccgctcttctgggtcctggatgcccatgccatctggcacatcagcaccatccctgtccacgtcctctttttcagctttctggaagatgacagcctgtacctgctgaaggaatcagaggacaagttcaagctggactgaagaccttggagcgagtctgccccagtggggatcctgcccccgccctgctggcctcccttctcccctcaacccttgagatgattttctcttttcaacttcttgaacttggacatgaaggatgtgggcccagaatcatgtggccagcccaccccctgttggccctcaccagccttggagtctgttctagggaaggcctcccagcatctgggactcgagagtgggcagcccctctacctcctggagctgaactggggtggaactgagtgtgctcttagctctaccgggaggacagctgcctgtttcctccccaccagcctcctccccacatccccagctgcctggctgggtcctgaagccctctgtctacctgggagaccagggaccacaggccttagggatacagggggtccccttctgttaccaccccccaccctcctccaggacaccactaggtggtgctggatgcttgttctttggccagccaaggttcacggcgattctccccatgggatcttgagggaccaagctgctgggattgggaaggagtttcaccctgaccnttgccctagccaggttcccaggaggcctcaccatactccctttcagggccagggctccagcaagcccagggcaaggatcctgtgctgctgtctggttgagagcctgccaccgtgtgtcgggagtgtgggccaggctgagtgcataggtgacagggccgtgagcatgggcctgggtgtgtgtgagctcaggcctaggtgcgcagtgtggagacgggtgttgtcggggaagaggtgtggcttcaaagtgtgtgtgtgcagggggtgggtgtgttagcgtgggttaggggaacgtgtgtgcgcgtgctggtgggcatgtgagatgagtgactgccggtgaatgtgtccacagttgagaggttggagcaggatgagggaatcctgtcaccatcaataatcacttgtggagcgccagctctgcccaagacgccacctgggcggacagccaggagctctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgttccagggtggccccagggcaggcaggggccacactatgcctgcgccctggtaaaggtgacccctgccatttaccagcagccctggcatgttcctgccccacaggaatagaatggagggagctccagaaactttccatcccaaaggcagtctccgtggttgaagcagactggatttttgctctgcccctgaccccttgtccctctttgagggaggggagctatgctaggactccaacctcagggactcgggtggcctgcgctagcttcttttgatactgaaaacttttaaggtgggagggtggcaagggatgtgcttaataaatcaattccaagcctca

SEQ ID NO: 300893 - DNA, 2024 bp, Homo sapiens
  misc_feature (903)..(903): n is a, c, g, or t
cggcggcgagccagggagaaaggatggccggcctggcggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatgagtgtatgtgggtcaccgttgggctctacctccaggaaggtcacaaagtgcctcagttccatggcaagtggcccttctcccggttcctgttctttcaagagccggcatcggccgtggcctcgtttctcaatggcctggccagcctggtgatgctctgccgctaccgcaccttcgtgccagcctcctcccccatgtaccacacctgtgtggccttcgcctggatgagaaaactgaggcacagcaaggctaaataacttgcccaaggacacacaggaaatgcagagccaggaactgaaccctggcagtctggctgtagggcttgcattcttaatgataccactacctcctggagctgaactggggtggaactgagtgtgctcttagctctaccgggaggacagctgcctgtttcctccccaccagcctcctccccacatccccagctgcctggctgggtcctgaagccctctgtctacctgggagaccagggaccacaggccttagggatacagggggtccccttctgttaccaccccccaccctcctccaggacaccactaggtggtgctggatgcttgttctttggccagccaaggttcacggcgattctccccatgggatcttgagggaccaagctgctgggattgggaaggagtttcaccctgaccnttgccctagccaggttcccaggaggcctcaccatactccctttcagggccagggctccagcaagcccagggcaaggatcctgtgctgctgtctggttgagagcctgccaccgtgtgtcgggagtgtgggccaggctgagtgcataggtgacagggccgtgagcatgggcctgggtgtgtgtgagctcaggcctaggtgcgcagtgtggagacgggtgttgtcggggaagaggtgtggcttcaaagtgtgtgtgtgcagggggtgggtgtgttagcgtgggttaggggaacgtgtgtgcgcgtgctggtgggcatgtgagatgagtgactgccggtgaatgtgtccacagttgagaggttggagcaggatgagggaatcctgtcaccatcaataatcacttgtggagcgccagctctgcccaagacgccacctgggcggacagccaggagctctccatggccaggctgcctgtgtgcatgttccctgtctggtgcccctttgcccgcctcctgcaaacctcacagggtccccacacaacagtgccctccagaagcagcccctcggaggcagaggaaggaaaatggggatggctggggctctctccatcctccttttctccttgccttcgcatggctggccttcccctccaaaacctccattcccctgctgccagcccctttgccatagcctgattttggggaggaggaaggggcgatttgagggagaaggggagaaagcttatggctgggtctggtttcttcccttcccagagggtcttactgttccagggtggccccagggcaggcaggggccacactatgcctgcgccctggtaaaggtgacccctgccatttaccagcagccctggcatgttcctgccccacaggaatagaatggagggagctccagaaactttccatcccaaaggcagtctccgtggttgaagcagactggatttttgctctgcccctgaccccttgtccctctttgagggaggggagctatgctaggactccaacctcagggactcgggtggcctgcgctagcttcttttgatactgaaaacttttaaggtgggagggtggcaagggatgtgcttaataaatcaattccaagcctca

SEQ ID NO: 300894 - DNA, 649 bp, Homo sapiens
caatacagctaaggaattatcccttgtaaataccacagacccgccctggagccaggccaagctggactgcataaagattggtatggccttagctcttagccaaacaccttcctgacaccatgagggccagcagcttcttgatcgtggtggtgttcctcatcgctgggacgctggttctagaggcagctgtcacgggagttcctgttaaaggtcaagacactgtcaaaggccgtgttccattcaatggacaagatcccgttaaaggacaagtttcagttaaaggtcaagataaagtcaaagcgcaagagccagtcaaaggtccagtctccactaagcctggctcctgccccattatcttgatccggtgcgccatgttgaatccccctaaccgctgcttgaaagatactgactgcccaggaatcaagaagtgctgtgaaggctcttgcgggatggcctgtttcgttccccagtgagagggagccggtccttgctgcacctgtgccgtccccagagctacaggccccatctggtcctaagtccctgctgcccttccccttcccacactgtccattcttcctcccattcaggatgcccacggctggagctgcctctctcatccactttccaataaagagttccttctgctcca

SEQ ID NO: 300895 - DNA, 521 bp, Homo sapiens
tttccggttcgaaaactagaggatcccctcatcgctgggatgctggttctagtggcagctgtcacgggagttcctgttaaaggtcaagacactgtcaaaggccgtgttccattcaatggacaagatcccgttaaaggacaagtttcagttaaaggtcaagataaagtcaaagcgcaagagccagtcaaaggtccagtctccactaagcctggctcctgccccattatcttgatccggtgcgccatgttgaatccccctaaccgctgcttgaaagatactgactgcccaggaatcaagaagtgctgtgaaggctcttgcgggatggcctgtttcgttccccagtgagagggagccggtccttgctgcacctgtgccgtccccagagctacaggccccatctggtcctaagtccctgctgcccttccccttcccacactgtccattcttcctcccattcaggatgcccacggctggagctgcctctctcatccactttccaataaagagttccttctgctcca

SEQ ID NO: 300896 - DNA, 945 bp, Homo sapiens
caatacagctaaggaattatcccttgtaaataccacagacccgccctggagccaggccaagctggactgcataaagattggtatggccttagctcttagccaaacaccttcctgacaccatgagggccagcagcttcttgatcgtggtggtgttcctcatcgctgggacgctggttctagaggcagctgtcacgggagttcctgttaaaggtcaagacactgtcaaaggccgtgttccattcaatggacaagatcccgttaaaggacaagtttcagttaaaggtcaagataaagtcaaagcgcaagagccagtcaaaggtccagtctccactaagcctggctcctgccccattatcttgatccggtgcgccatgttgaatccccctaaccgctgcttgaaagatactgactgcccaggaatcaagaagtgctgtgaaggctcttgcgggatggcctgtttcgttccccagtgagagggagccggtccttgctgcacctgtgccgtccccagagctacaggccccatctggtcctaagtccctgctgcccttccccttcccacactgtccattcttcctcccattcaggatgcccacggctggagctgcctctctcatccactttccaataaagagttccttctgctccaaaaaaaaaaaaaggaaaaaaaaaaaattgtgcgggcggctcgcggcgcggaaaaggcttcaaacccactcgggtgggcgggcgcccgagtggtatggacactggcaacagctggccaaagaagccgtggctagacaggggggcgttccccccaaaaaaaccgcggcgcccggcgtttgacaaaccagatggggttgggcaaccgggctctcacggcgcacgccgcacccccgcgcggtgcgggaggaagcgacgcagcggagagcagaggcacaacagacacgacagacacgagag

SEQ ID NO: 300897 - DNA, 474 bp, Homo sapiens
gggctcgtttcttcttttaacagttcctgttaaaggtcaagacactgtcaaaggccgtgttccattcaatggacaagatcccgttaaaggacaagtttcagttaaaggtcaagataaagtcaaagcgcaagagccagtcaaaggtccagtctccactaagcctggctcctgccccattatcttgatccggtgcgccatgttgaatccccctaaccgctgcttgaaagatactgactgcccaggaatcaagaagtgctgtgaaggctcttgcgggatggcctgtttcgttccccagtgagagggagccggtccttgctgcacctgtgccgtccccagagctacaggccccatctggtcctaagtccctgctgcccttccccttcccacactgtccattcttcctcccattcaggatgcccacggctggagctgcctctctcatccactttccaataaagagttccttctgctcca

SEQ ID NO: 300898 - DNA, 705 bp, Homo sapiens
caatacagctaaggaattatcccttgtaaataccacagacccgccctggagccaggccaagctggactgcataaagattggtatggccttagctcttagccaaacaccttcctgacaccatgagggccagcagcttcttgatcgtggtggtgttcctcatcgctgggacgctggttctagaggcagctgtcacgggagttcctgttaaaggtcaagacactgtcaaaggccgtgttccattcaatggacaagatcccgttaaaggacaagtttcagttaaaggtcaagataaagtcaaagcgcaagagccagtcaaaggtccagtctccactaagcctggctcctgccccattatcttgatccggtgcgccatgttgaatccccctaaccgctgcttgaaagatactgactgcccaggaatcaagaagtgctgtgaaggctcttgcgggatggcctgtttcgttccccagtgaggtgagcactagctggagaacgaggagacccctgaagacacaaaagaaggctgagcgagggagccggtccttgctgcacctgtgccgtccccagagctacaggccccatctggtcctaagtccctgctgcccttccccttcccacactgtccattcttcctcccattcaggatgcccacggctggagctgcctctctcatccactttccaataaagagttccttctgctcca

SEQ ID NO: 300899 - DNA, 589 bp, Homo sapiens
caatacagctaaggaattatcccttgtaaataccacagacccgccctggagccaggccaagctggactgcataaagattggtatggccttagctcttagccaaacaccttcctgacaccatgagggccagcagcttcttgatcgtggtggtgttcctcatcgctgggacgctggttctagaggcagctgtcacgggagttcctgttaaaggtcaagacactgtcaaaggccgtgttccattcaatggacaagatcccgttaaaggacaagtttcagttaaaggtcaagataaagtcaaagcgcaagagccagtcaaaggtccagtctccactaagcctggctcctgccccattatcttgatccggtgcgccatgttgaatccccctaaccgctgcttgaaagatactgactgcccaggaatcaagaagtgctgtgaaggctcttgcgggatggcctgtttcgttccccagtgagagggggccggtcctgcggcacgtggcggtccccgagctacggcccatcggtccaggtcctgcgcctcccctcccacgccttttctccctcagagccacgctggcgcccctatcgc

SEQ ID NO: 300900 - DNA, 525 bp, Homo sapiens
cgactctagcaggtccctgtctagcctcgccagtctcagcctcgccagtgcagcagggagccggtccttgctgcacctgtgccgtccccagagctacaggccccatctggtcctaagtccctgctgcccttccccttcccacactgtccattcttcctcccattcaggatgcccacggctggagctgcctctctcatccactttccaataaagagttccttctgctccaaaaaaaaaaaaaggaaaaaaaaaaaattgtgcgggcggctcgcggcgcggaaaaggcttcaaacccactcgggtgggcgggcgcccgagtggtatggacactggcaacagctggccaaagaagccgtggctagacaggggggcgttccccccaaaaaaaccgcggcgcccggcgtttgacaaaccagatggggttgggcaaccgggctctcacggcgcacgccgcacccccgcgcggtgcgggaggaagcgacgcagcggagagcagaggcacaacagacacgacagacacgagag

SEQ ID NO: 300901 - DNA, 1634 bp, Homo sapiens
tctgacctctgtgagtgaggctatgctaatgcctgactgcttatacttcacctgtacagtactagtccacacaattcctatgtggagtgttgttggcttgattttgaagtattgtttggggttctctgtaaatcaaagttttatagaaatgtggctattctacattcgtttttgtttaataccagccaccctgaataacatgattttgagaatcagcatactcctaaagtagcccatcatatggcagacacctcaaggctaagagaaatatgaacgttctcatttgtatagggtcatctttttgaaaatgaaagatttattaacacctgaaaaagataatacatagtatataagtagatctaagcacattaattagcaatttgattggttgcagcctctcctaggtaaacttgaatcatgaaggtactgaaatatatcctgcacagaaattcaccagggcaggagattgagtaaagtgctcctccacagagcatagcctggcatcctgaaatagaagtgtaagaatttttttaagtaaaagattattgcatatttatggattctttacacaatttttttattctatagtagatcctttagctcctgtatttaatatacagcagaatatactttttagtttccttggaaaggaacagttttcactgtctggtaataaaacgcaagatgcaataaatttaatccaaaataagttacagtaaaatagggcacttactagtttgaaagaaaatattaaatgattctgttagttcacagtgtggtcaatacctgtacatatgaacttcagtaggaaatttagtcccaggaaggaagaaaggtttaaagtgttccagccagtcttgtctcaagaattccaatcgtctttttttttcctccctggtactcagagtttacactaggtggcatgcaaggaaagctaacaaattcagaaactcgattctgtgggagcaggattctttggtactaatcacgatagtgggtccagctttggagttaaccatttgatttgtgatggtttttcttttctcctccccaccccaggatgaagtgtcctcttgctagcaccaataaaagatttctaattaacacaattaaaaacacattgccctctcataaagagcaagaccatgaacaaaaagagggcgataaggaaccagcgaagagccaggcccagaaagaagaaaacccgaagaaacacagaagccatccttacaagcacagcttccgcgctcgaggttccgccagttactccccgccacgaaagcggagcagccaggacaagtacgaaaagcggtccaaccggcggtgaggctggaaccagggccagccagccctgcgggcctccgtgctccttcggggtgcggtgtgcggagaaggcctgagctggcagggcaaacacctgagagtgactttgacattaggtcctttgttgtttttaaagaggctgctggccacaggcaaaaaaaatgacctagcaactcttgaggaaacaagtgcaaaggaggatgtcttggcaagtttaagctacttctgcagtgtagtagacttacatattgttgtttatcttgtttggaagtgtgtttcaaaataaacatgtctagaatttaaagttttca

SEQ ID NO: 300902 - DNA, 383 bp, Homo sapiens
  misc_feature (20)..(20): n is a, c, g, or t
tgaaatgagctcatgaatgnctgcaaacttgtcaaggcacatgttggcagacattcatgtgcttgacaagtttgaggccagcataaaggactataaggatcaaaaagcaagcagaaatgaatccacattctagtcctttatgcagtatacaaggagaactgtcctgtaggatattctcttcctgatggtgcagaacccagaattagaagtttgtggttacagcatactctgtccttcagaaaggcgtgattctagctgttgaccccttgcagctgttggaatctctgcaagaacctctgtattcttctaataaattccctcttttatttaaataaactagtttgactggtttctgttccatgcaaccaaatggtccttgagga

SEQ ID NO: 300903 - DNA, 2850 bp, Homo sapiens
ccccactcgccccgggctgtccccgccgcccgcctgattcccctgcggaagccccgctggctaggtgtctgcgcgcacccccggccgccgccaagagtggcacagctggggaaggagtgaacatccagaggaatcgcggggcggggtggggggaggccaggagaacaggtggcgcagggaagcagaaacgtagttgcgctggacagctggagtcgggcagggtcggggccagcggcgaggggacaagaagggccgattcgagaggaagcgcacctgagggagcacagcgaaggccgggacgcagggagctggatggagagcgagcctgggcggcgaaaggttgccgaggcgggggctgggcgcctgggaacaaagttgaaaatgcaactgcaagctccccggtgaaacaaataccgccttcaaccttcgtattctgtggtgactcatctcgcacgtgacccccctccctcttcaaggtgtgttgaccgactacagtttaagcctgtcgtcccacaaaaggcccgggagggccggggtcccaggaagggccatcctgggtcaacaccgccccagttgggaagtcgggccgctttcggacttgccactgggaagggaagtgatttgggggcggcaggtaaggccgcgccccttcgccatcacctggggaaaggtaccagagttgagccggggcgcccgcaggcctgtctgggcctcggggtaaggcggcgctggccccgccccctgcccctcccgccgcgagtggcctcgcgtggtcgcccaggtgagccgcggggccgcgagccaccgctcaccccgcgtcggggcgggggctgggggtggagcctcatgccccgccccgcggctgggccctgccgcgccgctgcggctcctcctccctccttccgtcctccgcgccttccgtcggtcggtccttgcttcctgcttcgcctccgcgcctcgcgctatgggacagagcccccgatccgccagcaccacctgaggatccagaaaccgccccagcgatggaagaggatcaggagctggagaggaaagcaatagaagaactgcttaaggaggcaaaacgtgggaaaactagagctgaaacaatgggacccatgggttggatgaagtgtcctcttgctagcaccaataaaagatttctaattaacacaattaaaaacacattgccctctcataaagagcaagaccatgaacaaaaagagggcgataaggaaccagcgaagagccaggcccagaaagaagaaaacccgaagaaacacagaagccatccttacaagcacagcttccgcgctcgaggttccgccagttactccccgccacgaaagcggagcagccaggacaagtacgaaaagcggtccaaccggcggtgaggctggaaccagggccagccagccctgcgggcctccgtgctccttcggggtgcggtgtgcggagaaggcctgagctggcagggcaaacacctgagagtgactttgacattaggtcctttgttgtttttaaagaggctgctggccacaggcaaaaaaaatgacctagcaactcttgaggaaacaagtgcaaaggaggatgtcttggcaagtttaagctacttctgcagtgtagtagacttacatattgttgtttatcttgtttggaagtgtgtttcaaaataaacatgtctagaatttaaagttttcagagattgttaaaactggttccaattttttggtcatttctcagaaaaataaaatacttataaatcctatattttactttttgggggtattacatttaaaatttagaaatcatcagtccagtgaccatatttatgaaaagctgtagccctccaaggtctgggaatttatcgagaagctctttgatagctctgcatttgttttcccttaggtgaacaatgtaggaaatcctcaaagtggctttgaatttaatgctccacttcagttaccagaggttaaaaatgggttttgttgtttcctgtgcattctcaaactcatttattagatagaacaatctttctatatttaatttttttaatatataggtcttaagtggtgctttaaaaagaaccctcacaagttaaaaattaagagttgtttcagtgctagatcttgccagctaaagacttgtgataccactatatagtatagttgttccagaaatcttcattttaaatagaagtgtttacaatgccttttttcccccagtattggttttcaatacctgttttcatatacaattacaaacctttcaaacctgtattccttctttatactcaggaaaatgtcaccaagcaccctcctccccagttcacaaaaggaagaagatgaagattctgtctccctgttccccctccccagttttccaaagtgtctgagcatatgcctggctgtcctcagatcatcaccatgccacatccctgctccctacttcctggcagccaagaaaagccctttctacatgctagaaggaaatacatccaaaaagttagcattggagtgttagaaactagaatagacctctccgccaccgagctgctgtgtcacgccctcagcctgctagggagtgacaagcccaagtcattcttgatccaccccttctcccaccccagatcccagggactcatcctgtgactttgtaaccacactcattcctttcaaacacagaggaggaattattgcttcatctgactttattcaaatctagttatgtattggcctaaattatttgtgcaaaatttgaaatgttttttatttaaatattagaaatagcacaaagtcatggagtttttaaaaattgttataattaagtaaaaataaagctgaattgtgtcat

SEQ ID NO: 300904 - DNA, 1623 bp, Homo sapiens
ccccactcgccccgggctgtccccgccgcccgcctgattcccctgcggaagccccgctggctaggtgtctgcgcgcacccccggccgccgccaagagtggcacagctggggaaggagtgaacatccagaggaatcgcggggcggggtggggggaggccaggagaacaggtggcgcagggaagcagaaacgtagttgcgctggacagctggagtcgggcagggtcggggccagcggcgaggggacaagaagggccgattcgagaggaagcgcacctgagggagcacagcgaaggccgggacgcagggagctggatggagagcgagcctgggcggcgaaaggttgccgaggcgggggctgggcgcctgggaacaaagttgaaaatgcaactgcaagctccccggtgaaacaaataccgccttcaaccttcgtattctgtggtgactcatctcgcacgtgacccccctccctcttcaaggtgtgttgaccgactacagtttaagcctgtcgtcccacaaaaggcccgggagggccggggtcccaggaagggccatcctgggtcaacaccgccccagttgggaagtcgggccgctttcggacttgccactgggaagggaagtgatttgggggcggcaggtaaggccgcgccccttcgccatcacctggggaaaggtaccagagttgagccggggcgcccgcaggcctgtctgggcctcggggtaaggcggcgctggccccgccccctgcccctcccgccgcgagtggcctcgcgtggtcgcccaggtgagccgcggggccgcgagccaccgctcaccccgcgtcggggcgggggctgggggtggagcctcatgccccgccccgcggctgggccctgccgcgccgctgcggctcctcctccctccttccgtcctccgcgccttccgtcggtcggtccttgcttcctgcttcgcctccgcgcctcgcgctatgggacagagcccccgatccgccagcaccacctgaggatccagaaaccgccccagcgatggaagaggatcaggagctggagagaaaaatatctggattgaagacctcaatggctgaaggcgagaggaagacagccctggaaatggtccaggcagctggaacagatagacactgtgtgacatttgtattgcacgaggaagaccataccctaggaaattctctacgttacatgatcatgaagaacccggaagtggaattttgtggttacactacgacccatccttcagagagcaaaattaatttacgcattcagactcgaggtacccttccagctgttgagccatttcagagaggcctgaatgagctcatgaatgtctgccaacatgtgcttgacaagtttgaggccagcataaaggactataaggatcaaaaagcaagcagaaatgaatccacattctagtcctttatgcagtatacaaggagaactgtcctgtaggatattctcttcctgatggtgcagaacccagaattagaagtttgtggttacagcatactctgtccttcagaaaggcgtgattctagctgttgaccccttgcagctgttggaatctctgcaagaacctctgtattcttctaataaattccctcttttatttaaa

SEQ ID NO: 300905 - DNA, 2171 bp, Homo sapiens
ggtatttctttgaataacagtgaatttgaaaaaatatagatatatacatatttggctgttcatgtcttttggttattcaaattaataagaaaagataattcttatattaaggatatatgatttaactgtctcatatcaaaaatatttttccagtttgtaatttttttctcttcaatgttgcttctctttatattaatagtttctttttaatttatgtgttcaaaattgtcaaccatttaaaaaaaaatttgccccagcaatcatgcttcaaaagttagttcctttcccaagatcatggacctggaatgaattgattttcagaacttagtagggtgactgcctctcaaatcttttcctttttcttatcaggaaagcaatagaagaactgcttaaggaggcaaaacgtgggaaaactagagctgaaacaatgggacccatgggttggatgaagtgtcctcttgctagcaccaataaaagatttctaattaacacaattaaaaacacattgccctctcataaagagcaagaccatgaacaaaaagagggcgataaggaaccagcgaagagccaggcccagaaagaagaaaacccgaagaaacacagaagccatccttacaagcacagcttccgcgctcgaggttccgccagttactccccgccacgaaagcggagcagccaggacaagtacgaaaagcggtccaaccggcggtgaggctggaaccagggccagccagccctgcgggcctccgtgctccttcggggtgcggtgtgcggagaaggcctgagctggcagggcaaacacctgagagtgactttgacattaggtcctttgttgtttttaaagaggctgctggccacaggcaaaaaaaatgacctagcaactcttgaggaaacaagtgcaaaggaggatgtcttggcaagtttaagctacttctgcagtgtagtagacttacatattgttgtttatcttgtttggaagtgtgtttcaaaataaacatgtctagaatttaaagttttcagagattgttaaaactggttccaattttttggtcatttctcagaaaaataaaatacttataaatcctatattttactttttgggggtattacatttaaaatttagaaatcatcagtccagtgaccatatttatgaaaagctgtagccctccaaggtctgggaatttatcgagaagctctttgatagctctgcatttgttttcccttaggtgaacaatgtaggaaatcctcaaagtggctttgaatttaatgctccacttcagttaccagaggttaaaaatgggttttgttgtttcctgtgcattctcaaactcatttattagatagaacaatctttctatatttaatttttttaatatataggtcttaagtggtgctttaaaaagaaccctcacaagttaaaaattaagagttgtttcagtgctagatcttgccagctaaagacttgtgataccactatatagtatagttgttccagaaatcttcattttaaatagaagtgtttacaatgccttttttcccccagtattggttttcaatacctgttttcatatacaattacaaacctttcaaacctgtattccttctttatactcaggaaaatgtcaccaagcaccctcctccccagttcacaaaaggaagaagatgaagattctgtctccctgttccccctccccagttttccaaagtgtctgagcatatgcctggctgtcctcagatcatcaccatgccacatccctgctccctacttcctggcagccaagaaaagccctttctacatgctagaaggaaatacatccaaaaagttagcattggagtgttagaaactagaatagacctctccgccaccgagctgctgtgtcacgccctcagcctgctagggagtgacaagcccaagtcattcttgatccaccccttctcccaccccagatcccagggactcatcctgtgactttgtaaccacactcattcctttcaaacacagaggaggaattattgcttcatctgactttattcaaatctagttatgtattggcctaaattatttgtgcaaaatttgaaatgttttttatttaaatattagaaatagcacaaagtcatggagtttttaaaaattgttataattaagtaaaaataaagctgaattgtgtcat

SEQ ID NO: 300906 - DNA, 2786 bp, Homo sapiens
tctgacctctgtgagtgaggctatgctaatgcctgactgcttatacttcacctgtacagtactagtccacacaattcctatgtggagtgttgttggcttgattttgaagtattgtttggggttctctgtaaatcaaagttttatagaaatgtggctattctacattcgtttttgtttaataccagccaccctgaataacatgattttgagaatcagcatactcctaaagtagcccatcatatggcagacacctcaaggctaagagaaatatgaacgttctcatttgtatagggtcatctttttgaaaatgaaagatttattaacacctgaaaaagataatacatagtatataagtagatctaagcacattaattagcaatttgattggttgcagcctctcctaggtaaacttgaatcatgaaggtactgaaatatatcctgcacagaaattcaccagggcaggagattgagtaaagtgctcctccacagagcatagcctggcatcctgaaatagaagtgtaagaatttttttaagtaaaagattattgcatatttatggattctttacacaatttttttattctatagtagatcctttagctcctgtatttaatatacagcagaatatactttttagtttccttggaaaggaacagttttcactgtctggtaataaaacgcaagatgcaataaatttaatccaaaataagttacagtaaaatagggcacttactagtttgaaagaaaatattaaatgattctgttagttcacagtgtggtcaatacctgtacatatgaacttcagtaggaaatttagtcccaggaaggaagaaaggtttaaagtgttccagccagtcttgtctcaagaattccaatcgtctttttttttcctccctggtactcagagtttacactaggtggcatgcaaggaaagctaacaaattcagaaactcgattctgtgggagcaggattctttggtactaatcacgatagtgggtccagctttggagttaaccatttgatttgtgatggtttttcttttctcctccccaccccaggatgaagtgtcctcttgctagcaccaataaaagatttctaattaacacaattaaaaacacattgccctctcataaagagcaagaccatgaacaaaaagagggcgataaggaaccagcgaagagccaggcccagaaagaagaaaacccgaagaaacacagaagccatccttacaagcacagcttccgcgctcgaggttccgccagttactccccgccacgaaagcggagcagccaggacaagtacgaaaagcggtccaaccggcggtgaggctggaaccagggccagccagccctgcgggcctccgtgctccttcggggtgcggtgtgcggagaaggcctgagctggcagggcaaacacctgagagtgactttgacattaggtcctttgttgtttttaaagaggctgctggccacaggcaaaaaaaatgacctagcaactcttgaggaaacaagtgcaaaggaggatgtcttggcaagtttaagctacttctgcagtgtagtagacttacatattgttgtttatcttgtttggaagtgtgtttcaaaataaacatgtctagaatttaaagttttcagagattgttaaaactggttccaattttttggtcatttctcagaaaaataaaatacttataaatcctatattttactttttgggggtattacatttaaaatttagaaatcatcagtccagtgaccatatttatgaaaagctgtagccctccaaggtctgggaatttatcgagaagctctttgatagctctgcatttgttttcccttaggtgaacaatgtaggaaatcctcaaagtggctttgaatttaatgctccacttcagttaccagaggttaaaaatgggttttgttgtttcctgtgcattctcaaactcatttattagatagaacaatctttctatatttaatttttttaatatataggtcttaagtggtgctttaaaaagaaccctcacaagttaaaaattaagagttgtttcagtgctagatcttgccagctaaagacttgtgataccactatatagtatagttgttccagaaatcttcattttaaatagaagtgtttacaatgccttttttcccccagtattggttttcaatacctgttttcatatacaattacaaacctttcaaacctgtattccttctttatactcaggaaaatgtcaccaagcaccctcctccccagttcacaaaaggaagaagatgaagattctgtctccctgttccccctccccagttttccaaagtgtctgagcatatgcctggctgtcctcagatcatcaccatgccacatccctgctccctacttcctggcagccaagaaaagccctttctacatgctagaaggaaatacatccaaaaagttagcattggagtgttagaaactagaatagacctctccgccaccgagctgctgtgtcacgccctcagcctgctagggagtgacaagcccaagtcattcttgatccaccccttctcccaccccagatcccagggactcatcctgtgactttgtaaccacactcattcctttcaaacacagaggaggaattattgcttcatctgactttattcaaatctagttatgtattggcctaaattatttgtgcaaaatttgaaatgttttttatttaaatattagaaatagcacaaagtcatggagtttttaaaaattgttataattaagtaaaaataaagctgaattgtgtcat

SEQ ID NO: 300907 - DNA, 1674 bp, Homo sapiens
ccccactcgccccgggctgtccccgccgcccgcctgattcccctgcggaagccccgctggctaggtgtctgcgcgcacccccggccgccgccaagagtggcacagctggggaaggagtgaacatccagaggaatcgcggggcggggtggggggaggccaggagaacaggtggcgcagggaagcagaaacgtagttgcgctggacagctggagtcgggcagggtcggggccagcggcgaggggacaagaagggccgattcgagaggaagcgcacctgagggagcacagcgaaggccgggacgcagggagctggatggagagcgagcctgggcggcgaaaggttgccgaggcgggggctgggcgcctgggaacaaagttgaaaatgcaactgcaagctccccggtgaaacaaataccgccttcaaccttcgtattctgtggtgactcatctcgcacgtgacccccctccctcttcaaggtgtgttgaccgactacagtttaagcctgtcgtcccacaaaaggcccgggagggccggggtcccaggaagggccatcctgggtcaacaccgccccagttgggaagtcgggccgctttcggacttgccactgggaagggaagtgatttgggggcggcaggtaaggccgcgccccttcgccatcacctggggaaaggtaccagagttgagccggggcgcccgcaggcctgtctgggcctcggggtaaggcggcgctggccccgccccctgcccctcccgccgcgagtggcctcgcgtggtcgcccaggtgagccgcggggccgcgagccaccgctcaccccgcgtcggggcgggggctgggggtggagcctcatgccccgccccgcggctgggccctgccgcgccgctgcggctcctcctccctccttccgtcctccgcgccttccgtcggtcggtccttgcttcctgcttcgcctccgcgcctcgcgctatgggacagagcccccgatccgccagcaccacctgaggatccagaaaccgccccagcgatggaagaggatcaggagctggagagaaaaatatctggattgaagacctcaatggctgaaggcgagaggaagacagccctggaaatggtccaggcagctggaacagatagacactgtgtgacatttgtattgcacgaggaagaccataccctaggaaattctctacgttacatgatcatgaagaacccggaagtggaattttgtggttacactacgacccatccttcagagagcaaaattaatttacgcattcagactcgaggtacccttccagctgttgagccatttcagagaggcctgaatgagctcatgaatgtctgccaacatgtgcttgacaagtttgaggccagcataaaggactataaggatcaaaaagcaagcagaaatgaatccacattctagtcctttatgcagtatacaaggagaactgtcctgtaggatattctcttcctgatggtgcagaacccagaattagaagtttgtggttacagcatactctgtccttcagaaaggcgtgattctagctgttgaccccttgcagctgttggaatctctgcaagaacctctgtattcttctaataaattccctcttttatttaaataaactagtttgactggtttctgttccatgcaaccaaatggtccttgagga

SEQ ID NO: 300908 - DNA, 1550 bp, Homo sapiens
ccccactcgccccgggctgtccccgccgcccgcctgattcccctgcggaagccccgctggctaggtgtctgcgcgcacccccggccgccgccaagagtggcacagctggggaaggagtgaacatccagaggaatcgcggggcggggtggggggaggccaggagaacaggtggcgcagggaagcagaaacgtagttgcgctggacagctggagtcgggcagggtcggggccagcggcgaggggacaagaagggccgattcgagaggaagcgcacctgagggagcacagcgaaggccgggacgcagggagctggatggagagcgagcctgggcggcgaaaggttgccgaggcgggggctgggcgcctgggaacaaagttgaaaatgcaactgcaagctccccggtgaaacaaataccgccttcaaccttcgtattctgtggtgactcatctcgcacgtgacccccctccctcttcaaggtgtgttgaccgactacagtttaagcctgtcgtcccacaaaaggcccgggagggccggggtcccaggaagggccatcctgggtcaacaccgccccagttgggaagtcgggccgctttcggacttgccactgggaagggaagtgatttgggggcggcaggtaaggccgcgccccttcgccatcacctggggaaaggtaccagagttgagccggggcgcccgcaggcctgtctgggcctcggggtaaggcggcgctggccccgccccctgcccctcccgccgcgagtggcctcgcgtggtcgcccaggtgagccgcggggccgcgagccaccgctcaccccgcgtcggggcgggggctgggggtggagcctcatgccccgccccgcggctgggccctgccgcgccgctgcggctcctcctccctccttccgtcctccgcgccttccgtcggtcggtccttgcttcctgcttcgcctccgcgcctcgcgctatgggacagagcccccgatccgccagcaccacctgaggatccagaaaccgccccagcgatggaagaggatcaggagctggagagaaaaatatctggattgaagacctcaatggctgaaggcgagaggaagacagccctggaaattctctacgttacatgatcatgaagaacccggaagtggaattttgtggttacactacgacccatccttcagagagcaaaattaatttacgcattcagactcgaggtacccttccagctgttgagccatttcagagaggcctgaatgagctcatgaatgtctgccaacatgtgcttgacaagtttgaggccagcataaaggactataaggatcaaaaagcaagcagaaatgaatccacattctagtcctttatgcagtatacaaggagaactgtcctgtaggatattctcttcctgatggtgcagaacccagaattagaagtttgtggttacagcatactctgtccttcagaaaggcgtgattctagctgttgaccccttgcagctgttggaatctctgcaagaacctctgtattcttctaataaattccctcttttatttaaa

SEQ ID NO: 300909 - DNA, 971 bp, Homo sapiens
ccccactcgccccgggctgtccccgccgcccgcctgattcccctgcggaagccccgctggctaggtgtctgcgcgcacccccggccgccgccaagagtggcacagctggggaaggagtgaacatccagaggaatcgcggggcggggtggggggaggccaggagaacaggtggcgcagggaagcagaaacgtagttgcgctggacagctggagtcgggcagggtcggggccagcggcgaggggacaagaagggccgattcgagaggaagcgcacctgagggagcacagcgaaggccgggacgcagggagctggatggagagcgagcctgggcggcgaaaggttgccgaggcgggggctgggcgcctgggaacaaagttgaaaatgcaactgcaagctccccggtgaaacaaataccgccttcaaccttcgtattctgtggtgactcatctcgcacgtgacccccctccctcttcaaggtgtgttgaccgactacagtttaagcctgtcgtcccaccccagttgggaagtcgggccgctttcggacttgccactgggaagggaagtgatttgggggcggcaggtaaggccgcgccccttcgccatcacctggggaaaggtaccagagttgagccggggcgcccgcaggcctgtctgggcctcggggtaaggcggcgctggccccgccccctgcccctcccgccgcgagtggcctcgcgtggtcgcccaggtgagccgcggggccgcgagccaccgctcaccccgcgtcggggcgggggctgggggtggagcctcatgccccgccccgcggctgggccctgccgcgccgctgcggctcctcctccctccttccaatcttcatacctttcatcaatcaatccttactgtctacttcacctccataccttgcactattatacataaccccctatcccccactaccaccttaagattcataaaccccccaatcaatt

SEQ ID NO: 300910 - DNA, 1663 bp, Homo sapiens
ccccactcgccccgggctgtccccgccgcccgcctgattcccctgcggaagccccgctggctaggtgtctgcgcgcacccccggccgccgccaagagtggcacagctggggaaggagtgaacatccagaggaatcgcggggcggggtggggggaggccaggagaacaggtggcgcagggaagcagaaacgtagttgcgctggacagctggagtcgggcagggtcggggccagcggcgaggggacaagaagggccgattcgagaggaagcgcacctgagggagcacagcgaaggccgggacgcagggagctggatggagagcgagcctgggcggcgaaaggttgccgaggcgggggctgggcgcctgggaacaaagttgaaaatgcaactgcaagctccccggtgaaacaaataccgccttcaaccttcgtattctgtggtgactcatctcgcacgtgacccccctccctcttcaaggtgtgttgaccgactacagtttaagcctgtcgtcccacaaaaggcccgggagggccggggtcccaggaagggccatcctgggtcaacaccgccccagttgggaagtcgggccgctttcggacttgccactgggaagggaagtgatttgggggcggcaggtaaggccgcgccccttcgccatcacctggggaaaggtaccagagttgagccggggcgcccgcaggcctgtctgggcctcggggtaaggcggcgctggccccgccccctgcccctcccgccgcgagtggcctcgcgtggtcgcccaggtgagccgcggggccgcgagccaccgctcaccccgcgtcggggcgggggctgggggtggagcctcatgccccgccccgcggctgggccctgccgcgccgctgcggctcctcctccctccttccgtcctccgcgccttccgtcggtcggtccttgcttcctgcttcgcctccgcgcctcgcgctatgggacagagcccccgatccgccagcaccacctgaggatccagaaaccgccccagcgatggaagaggatcaggagctggagagaaaaatatctggattgaagacctcaatggctgaaggcgagaggaagacagccctggaaatggtccaggcagctggaacagatagacactgtgtgacatttgtattgcacgaggaagaccataccctaggaaattctctacgttacatgatcatgaagaacccggaagtggaattttgtggttacactacgacccatccttcagagagcaaaattaatttacgcattcagactcgaggtacccttccagctgttgagccatttcagagaggcctgaatgagctcatgaatgtctgccaacatgtgcttgacaagtttgaggccagcataaaggactataaggatcaaaaagcaagcagaaatgaatccacattctagtcctttatgcagtatacaaggagaactgtcctgtaggatattctcttcctgatggtgcagaacccagaattagaagtttgtggttacagcatactctgtccttcagaaaggcgtgattctagctgttgaccccttgcagctgttggaatctctgcaagaacctctgtattcttctaataaattccctcttttatttaaaaacaacagaaaaaaacaaaaaaggggggggggaaagaatc

SEQ ID NO: 300911 - DNA, 1698 bp, Homo sapiens
ccccactcgccccgggctgtccccgccgcccgcctgattcccctgcggaagccccgctggctaggtgtctgcgcgcacccccggccgccgccaagagtggcacagctggggaaggagtgaacatccagaggaatcgcggggcggggtggggggaggccaggagaacaggtggcgcagggaagcagaaacgtagttgcgctggacagctggagtcgggcagggtcggggccagcggcgaggggacaagaagggccgattcgagaggaagcgcacctgagggagcacagcgaaggccgggacgcagggagctggatggagagcgagcctgggcggcgaaaggttgccgaggcgggggctgggcgcctgggaacaaagttgaaaatgcaactgcaagctccccggtgaaacaaataccgccttcaaccttcgtattctgtggtgactcatctcgcacgtgacccccctccctcttcaaggtgtgttgaccgactacagtttaagcctgtcgtcccacaaaaggcccgggagggccggggtcccaggaagggccatcctgggtcaacaccgccccagttgggaagtcgggccgctttcggacttgccactgggaagggaagtgatttgggggcggcaggtaaggccgcgccccttcgccatcacctggggaaaggtaccagagttgagccggggcgcccgcaggcctgtctgggcctcggggtaaggcggcgctggccccgccccctgcccctcccgccgcgagtggcctcgcgtggtcgcccaggtgagccgcggggccgcgagccaccgctcaccccgcgtcggggcgggggctgggggtggagcctcatgccccgccccgcggctgggccctgccgcgccgctgcggctcctcctccctccttccgtcctccgcgccttccgtcggtcggtccttgcttcctgcttcgcctccgcgcctcgcgctatgggacagagcccccgatccgccagcaccacctgaggatccagaaaccgccccagcgatggaagaggatcaggagctggagaggaaagcaatagaagaactgcttaaggaggcaaaacgtgggaaaactagagctgaaacaatgggacccatgggttggatgaagtgtcctcttgctagcaccaataaaagatttctaattaacacaattaaaaacacattgccctctcataaagagcaagaccatgaacaaaaagagggcgataaggaaccagcgaagagccaggcccagaaagaagaaaacccgaagaaacacagaagccatccttacaagcacagcttccgcgctcgaggttccgccagttactccccgccacgaaagcggagcagccaggacaagtacgaaaagcggtccaaccggcggtgaggctggaaccagggccagccagccctgcgggcctccgtgctccttcggggtgcggtgtgcggagaaggcctgagctggcagggcaaacacctgagagtgactttgacattaggtcctttgttgtttttaaagaggctgctggccacaggcaaaaaaaatgacctagcaactcttgaggaaacaagtgcaaaggaggatgtcttggcaagtttaagctacttctgcagtgtagtagacttacatattgttgtttatcttgtttggaagtgtgtttcaaaataaacatgtctagaatttaaagttttca

SEQ ID NO: 300912 - DNA, 1569 bp, Homo sapiens
ccccactcgccccgggctgtccccgccgcccgcctgattcccctgcggaagccccgctggctaggtgtctgcgcgcacccccggccgccgccaagagtggcacagctggggaaggagtgaacatccagaggaatcgcggggcggggtggggggaggccaggagaacaggtggcgcagggaagcagaaacgtagttgcgctggacagctggagtcgggcagggtcggggccagcggcgaggggacaagaagggccgattcgagaggaagcgcacctgagggagcacagcgaaggccgggacgcagggagctggatggagagcgagcctgggcggcgaaaggttgccgaggcgggggctgggcgcctgggaacaaagttgaaaatgcaactgcaagctccccggtgaaacaaataccgccttcaaccttcgtattctgtggtgactcatctcgcacgtgacccccctccctcttcaaggtgtgttgaccgactacagtttaagcctgtcgtcccacaaaaggcccgggagggccggggtcccaggaagggccatcctgggtcaacaccgccccagttgggaagtcgggccgctttcggacttgccactgggaagggaagtgatttgggggcggcaggtaaggccgcgccccttcgccatcacctggggaaaggtaccagagttgagccggggcgcccgcaggcctgtctgggcctcggggtaaggcggcgctggccccgccccctgcccctcccgccgcgagtggcctcgcgtggtcgcccaggtgagccgcggggccgcgagccaccgctcaccccgcgtcggggcgggggctgggggtggagcctcatgccccgccccgcggctgggccctgccgcgccgctgcggctcctcctccctccttccgtcctccgcgccttccgtcggtcggtccttgcttcctgcttcgcctccgcgcctcgcgctatgggacagagcccccgatccgccagcaccacctgaggatccagaaaccgccccagcgatggaagaggatcaggagctggagagaaaaatatctggattgaagacctcaatggctgaaggcgagaggaagacagccctggaaatggtccaggcagctggaacagatagacactgtgtgacatttgtattgcacgaggaagaccataccctaggaaattctctacgttacatgatcatgaagaacccggaagtggaattttgtggttacactacgacccatccttcagagagccagagaggcctgaatgagctcatgaatgtctgccaacatgtgcttgacaagtttgaggccagcataaaggactataaggatcaaaaagcaagcagaaatgaatccacattctagtcctttatgcagtatacaaggagaactgtcctgtaggatattctcttcctgatggtgcagaacccagaattagaagtttgtggttacagcatactctgtccttcagaaaggcgtgattctagctgttgaccccttgcagctgttggaatctctgcaagaacctctgtattcttctaataaattccctcttttatttaaa

SEQ ID NO: 300913 - DNA, 13684 bp, Homo sapiens
cgccgcctgtgcagccgctgccgccgccgccgccgccgccgccgccgccgccgccgccgccgccgctgccgccccggctgccgcgccgcgccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaagacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggagatgacccattcctggcctactcctctcacttccatgcatactgctggacactctgagcagagcaccttttccatcccaggacaggaatcgcagcatctgaccccaggattcaccttacaaaagtggaatgacccaaccaccagagcttctacaaagtcagtgtctttcaaatcgatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagctatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcctgtagactgttaattacttaataatctcattgggaaaatactagtagttttatatttggatgacataattggaaaaagcagattagctgctactacttttaaaagacttaaggtcgggatgcctttttttccatgtaaggaaatgaaaagacccaaaatcttcaggcaaaaagcaagttgcaaaattagaaaccattggctaaaaatgtgttttgttgagtttccaaatggatgaattttcatttggacattacatcactaaattcattagattttgtctgcattggaaagatactcttctagcatatctttcccaaagatatctaatttggattctgtttcatgcaaatttgcatcccggaggttgaagttggagtttgaggttggaaaatatctttgaaggcagaatcagttgagttgtgagggtgaagcctcacatacttctcaacagacatgataaaattcacctgcatgagttggcaggtgggagaaccaaactggatcactgggtaagactactcagtaaagcaatgaactgcttgcttagagaagcatcactatccccattgagaaaaatgtgtggcaagatgatacagctacacagtatcaaatgaatgggtcaattcagcacccccaaatttaattctgtggggaaaaattattgagccagttgtcagtgttctgttacatgactggcagactaaattcttcatcgttgttgttattgttgttgttgtttctcattttcactcgcacggccttattctcataattaaaatctaattcattttctctttagtgttagtagactccaacaacagaagtggcatctgtgtattcataatcagcatttaccctggcaggagactaatcagataggccggtctcagacattaatcctaccatctgatatttttggtgaaggaaaaagtattaattctctttccatcctcctcctcagaaatatagaagccctctttaccaaaatcatcacattttactctgtaatctaccagctaaaagaaaattgcattgaagccccacaaagccagattgcagttcttgcccctttttgcgtctgacatgagatgttaaagaattattcatagtgctcacattgggttaggggacactgaactgctttttagatccatgatcagtcatcattcttctaagagattggagctttgctgtttcattaactgtgcagtgtagactaatggtgtttaataaaaatcattcaaaatttcaaactcttttgccagtgacctcaattttgttggctctgtgatttgtatcagactttgaggagggaagggggaagtgaaggaagcctacgtccaggcccctgacaggatgctgcagtagcaagctcaagctcgcctgcctgccagcagttgctggtgagcagcagcatgcagaccagctgtgggaagcctcctgaagaatgccccagctgatgctttcagctgggaatagtttgttcctattggggaactcattgttctccagtctctgcagcaggaagccagctgtcatattcggagggaatttcagatgctttacctttttggttttgtcctgcatcactcatgtggctacgaaagtgtctctgagaatagagcccaatgtggtgacaatgggtagtcaaatgcaccccagatgctcaagccctgttgtggttctgcagtgtttatgaaattgggaggaaggagaccctggacagtaagcaaaattggagacactccaacgaggctaagttaatgccgtgttgcccagaacaagatctagcttctcatttggtcagcctagcatgcaaccagtggtgtgctggtaaaatgtttaacaaccagctcgctgagaatagaaagcacctggtttgcaccatttgccaatttccatggcataaatactaccactttagatgattttaagctaccaactgtgatgtcactgaacacatggttggaaagagatgcacgcagttggctcttgcaagcctgggcaaaaatgcttcaacacgccactggatgcagccagtcagagggttcatatttaatatatgtgttcatgtggacacacacagacacacacacacaaactcacccttacacacacacttcgatgactaaaacaattacatagttttaagatatgaatcaatgtgtgaatgtagaaagcttatgataaggccctagaggtatgggttgccctggaagcctaggttttaagcaggagaatagctgagaagaatgaagccctcctgagctgaaaggagagatggatcaatggagatggttccatcatctccttccatatctcacaggtaaaatgggcactcagaaaaccctcacgattgattttttaaaaagataagtgagtgttttttattttattattattgtcatcattattttgatttacaaatgctatttgtaacttttacatgtaactaggataaagtatttacgggaactctatggagaatagcacaatccagaatttactgtgtttttcttttatgtgacgtggaaactcagtaattctcccaccttcacattgttgttcataagaattttactttagttattagggaatctaagttttttgttaacatttgtttttagttaaaagtatctacttactgttttagctctgaactcaaaccagaatatctctgtatcaattgcatgactattcagaaacaataatccaaaccaaaataattctttttccacccagtacgaagaaaactaagctcagtaacaagaaggcataaactaaagtatataatgaggctttcattaaatacacacacacacacactcacacacacacacatacactttttaaatttttaaattaggcctccacacataaatcattttgaaagtagaatagaaaatctcaaagaattcattctcctggtcctgtgcatcttctgcagttaataagaggtttgtatctggaaagatggaagaacttgttctaaaatcttatttttcaaaaaaaaatttccattttctctctgggcctgtatccatggttgaatgttagccctggaggagatccatgtcttactcgctctttctggcccttctgtcttttgcctctgcaattctttttgtagctggcacgatagcagggactgggggtctatcctttcatggtattgctacaatatttgtccttactggaaaatggtaacatccgggtctgatttaattggcattacacttacacagggactctgagcacccccgtcaccacaccagacagtggaccagttttcacagctacaaagagctagaaatgtgtttaacatcatccagtgcatcccctaattcaaaaccatcctcactaatcaatcatattcacccataaatattacaaatgagattgattccatctcaagacaatttgtcaaatacttaattttcttcctggatgattctacttactggatattttagaaagagaaatgtctgagataaaatccctcacatttactcaatataacaaattactgtttctactcctattctgagtagtgcttctgaagattgtttgctgtagtgttgtctttgataaaatgaatgtcagtagtgagccttttagagataccatgctcagacatcctctttgggatcagaagatacctaaaattctccccttttgcccacttggttagatgagtgatatattctttggatcctgcaaagaagagattggtttcttttcttttctggtggtggtagtggttgtatctgtggctgtgatggttgttgttacttgtctctctctctctctggctctggcttttgctttcctgctagtgttctttctctttccaaacaaatagttaaattaaacgtgagcttctgaattgtacttgttcatactttcaaaacataacagattaataaaaatagatgtgtcctgatttaaaacatgccccctggaaaggcatgctgtattatgaaatcgtgataatataactgcattattacatggcagtataaatattagtctgttgaattcatttgtccaattgtataactttgtggagcagtgttttgacctttgatacataattctggagcaagtggagtggttgcaggcagatgagacagtgttatatcaggatttttcaatcaactttagttggaggcctggcaattacaaacatcttcagatgtttctgtaaccattataaatatgaaaaaaacctcttcaaaaaatttcccatagtacttcagtcaagactttttaggtttatcttttttttttcatttctccttttccttttccattatttttcgatgggggggttgttatcattgactgaagaaatattttgattgcaatggtctctctctctctccccctctctctctctctcctctattctttcctccttccctctgtccatcacccctcattaaaatattgaaatctggagtctttgataaatctgcattagaccaggctatatgctaggaatgaaatctgggcaaatatcgatgggttttcaaagaatgctccatgttcattgggccctttcacaccccacagtgataaatgaaaaggatagaggtagttttttcaaaagagcactttaataatatcctctgagacctaatgcagtttaacaaatgactccacctatttttccagtaggtaaattgactgagacttgcaaaatacccctgagagttgtcaggggtgtcttctgcctggtctatagcgtgtgtgtttgctttgtatctaacaggcacattcacgtctcgtgtactcatatgaagtatttcctaacattcccattagcctgtatataagaatcagaaagataatcccaacatgttgtaaatgaagatgtgactctataacctttctcttcttcctggaaaaaaaaggacattttcatgcatattttaaacagaaattttgtatatttaagtgtcatagaaaatatttattgagtaactgggacacaaatgggaatttaattgtcatcatatgctttgtgtgtggggatgcttaccaacaccatgtcgctggaccattgtggcaagccataactgcacaaagagtacacatcgtcagtgtgtgtgtgtgtgtgtgtgtgcgcgcacgcacgtgcgtgtgtgtgtccctgcatgtgcaacatgtctagcttgctgtccttcatgggattttagctttcccttcttgaaaaacattattttacagttccaggaggccctggttacattactatatgaaggcagtgatttgaaatgaaaattcctttcctcttggaagctttggtcataatatcatggttcaattaaacggattccaccggactttgtgatgaaaaaggctctgttaaaatccaattgagtttccaagaggaaattgtagtaggtcaagatgcatgagagggaagatggaggccacctcagctggagaacatgagctgagttgagccctcagtgttgaagttgacttgctccaagctgcagtctaaaaccctggggcccgtgcctggcctatgctccctcccaagtaagtagaggagcagaaccatcaggaacagcctgcctggctcctatgaagaaaacttcctgacgtcctgtccccaaaggaagaccctttccccaagggcaccccaggtggccattaaattgtgatgatcattcagaaagtgcccccttggctttatgagaatccaattagtcttctgaaccaccttttcttgggtgcagatttccaacattcatgctcattgcagatccaccaactgtcactgttcttaacaagcatgctcgtcttgtcagaatttcagtaagttccaatttcctgtacagaccagggtaaactgttctaaaatcaatcaattaatgaaatgttatctggtttttaaaagctggtttcatgtgctttatgtgtataaaactatatctgcctgtgtggctttgcatttcaaatgtgtggcgcacaagcgttttgttggtgctttgttctcagtacagtaactctgtgtacaaacattttaatgtggttttgttgttttccaacaagatgtctctgtaaaaatgatattggctgagctggtgcgttggtttctctcatagaggcattaactatactgccaatgcattgaattatttaaaaatgcaaaataaaatttttatgaaaatctca

SEQ ID NO: 300914 - DNA, 1878 bp, Homo sapiens
cgccgcctgtgcagccgctgccgccgccgccgccgccgccgccgccgccgccgccgccgccgccgctgccgccccggctgccgcgccgcgccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaagacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggaatcgcagcatctgaccccaggattcaccttacaaaagtggaatgacccaaccaccagagcttctacaaagatgcttgaggatgacctgaagctgagcagtgatgaagatgaccttgagcctgtgaagaccttgaccactcagtgcactgccactgagctctaccaggctgttgaaaaggcaaaacctaggaataatcctgtgaagtaagttattatttttattagttgcaaatgttaattttaacggactcgatgcatgtgaaaaaataaggtcataaaagagaccttggattttgagttaatctctattcatgacaatttaa

SEQ ID NO: 300915 - DNA, 5254 bp, Homo sapiens
tgttgctatgtgcgaaattgtttatcttaaccatgtcgggaatcttaagtcccctttaaatgtttttgccctcagagtttctttcagtttgtgggtggggaagccccacaaagccagattgcagttcttgcccctttttgcgtctgacatgagatgttaaagaattattcatagtgctcacattgggttaggggacactgaactgctttttagatccatgatcagtcatcattcttctaagagattggagctttgctgtttcattaactgtgcagtgtagactaatggtgtttaataaaaatcattcaaaatttcaaactcttttgccagtgacctcaattttgttggctctgtgatttgtatcagactttgaggagggaagggggaagtgaaggaagcctacgtccaggcccctgacaggatgctgcagtagcaagctcaagctcgcctgcctgccagcagttgctggtgagcagcagcatgcagaccagctgtgggaagcctcctgaagaatgccccagctgatgctttcagctgggaatagtttgttcctattggggaactcattgttctccagtctctgcagcaggaagccagctgtcatattcggagggaatttcagatgctttacctttttggttttgtcctgcatcactcatgtggctacgaaagtgtctctgagaatagagcccaatgtggtgacaatgggtagtcaaatgcaccccagatgctcaagccctgttgtggttctgcagtgtttatgaaattgggaggaaggagaccctggacagtaagcaaaattggagacactccaacgaggctaagttaatgccgtgttgcccagaacaagatctagcttctcatttggtcagcctagcatgcaaccagtggtgtgctggtaaaatgtttaacaaccagctcgctgagaatagaaagcacctggtttgcaccatttgccaatttccatggcataaatactaccactttagatgattttaagctaccaactgtgatgtcactgaacacatggttggaaagagatgcacgcagttggctcttgcaagcctgggcaaaaatgcttcaacacgccactggatgcagccagtcagagggttcatatttaatatatgtgttcatgtggacacacacagacacacacacacaaactcacccttacacacacacttcgatgactaaaacaattacatagttttaagatatgaatcaatgtgtgaatgtagaaagcttatgataaggccctagaggtatgggttgccctggaagcctaggttttaagcaggagaatagctgagaagaatgaagccctcctgagctgaaaggagagatggatcaatggagatggttccatcatctccttccatatctcacaggtaaaatgggcactcagaaaaccctcacgattgattttttaaaaagataagtgagtgttttttattttattattattgtcatcattattttgatttacaaatgctatttgtaacttttacatgtaactaggataaagtatttacgggaactctatggagaatagcacaatccagaatttactgtgtttttcttttatgtgacgtggaaactcagtaattctcccaccttcacattgttgttcataagaattttactttagttattagggaatctaagttttttgttaacatttgtttttagttaaaagtatctacttactgttttagctctgaactcaaaccagaatatctctgtatcaattgcatgactattcagaaacaataatccaaaccaaaataattctttttccacccagtacgaagaaaactaagctcagtaacaagaaggcataaactaaagtatataatgaggctttcattaaatacacacacacacacactcacacacacacacatacactttttaaatttttaaattaggcctccacacataaatcattttgaaagtagaatagaaaatctcaaagaattcattctcctggtcctgtgcatcttctgcagttaataagaggtttgtatctggaaagatggaagaacttgttctaaaatcttatttttcaaaaaaaaatttccattttctctctgggcctgtatccatggttgaatgttagccctggaggagatccatgtcttactcgctctttctggcccttctgtcttttgcctctgcaattctttttgtagctggcacgatagcagggactgggggtctatcctttcatggtattgctacaatatttgtccttactggaaaatggtaacatccgggtctgatttaattggcattacacttacacagggactctgagcacccccgtcaccacaccagacagtggaccagttttcacagctacaaagagctagaaatgtgtttaacatcatccagtgcatcccctaattcaaaaccatcctcactaatcaatcatattcacccataaatattacaaatgagattgattccatctcaagacaatttgtcaaatacttaattttcttcctggatgattctacttactggatattttagaaagagaaatgtctgagataaaatccctcacatttactcaatataacaaattactgtttctactcctattctgagtagtgcttctgaagattgtttgctgtagtgttgtctttgataaaatgaatgtcagtagtgagccttttagagataccatgctcagacatcctctttgggatcagaagatacctaaaattctccccttttgcccacttggttagatgagtgatatattctttggatcctgcaaagaagagattggtttcttttcttttctggtggtggtagtggttgtatctgtggctgtgatggttgttgttacttgtctctctctctctctggctctggcttttgctttcctgctagtgttctttctctttccaaacaaatagttaaattaaacgtgagcttctgaattgtacttgttcatactttcaaaacataacagattaataaaaatagatgtgtcctgatttaaaacatgccccctggaaaggcatgctgtattatgaaatcgtgataatataactgcattattacatggcagtataaatattagtctgttgaattcatttgtccaattgtataactttgtggagcagtgttttgacctttgatacataattctggagcaagtggagtggttgcaggcagatgagacagtgttatatcaggatttttcaatcaactttagttggaggcctggcaattacaaacatcttcagatgtttctgtaaccattataaatatgaaaaaaacctcttcaaaaaatttcccatagtacttcagtcaagactttttaggtttatcttttttttttcatttctccttttccttttccattatttttcgatgggggggttgttatcattgactgaagaaatattttgattgcaatggtctctctctctctccccctctctctctctctcctctattctttcctccttccctctgtccatcacccctcattaaaatattgaaatctggagtctttgataaatctgcattagaccaggctatatgctaggaatgaaatctgggcaaatatcgatgggttttcaaagaatgctccatgttcattgggccctttcacaccccacagtgataaatgaaaaggatagaggtagttttttcaaaagagcactttaataatatcctctgagacctaatgcagtttaacaaatgactccacctatttttccagtaggtaaattgactgagacttgcaaaatacccctgagagttgtcaggggtgtcttctgcctggtctatagcgtgtgtgtttgctttgtatctaacaggcacattcacgtctcgtgtactcatatgaagtatttcctaacattcccattagcctgtatataagaatcagaaagataatcccaacatgttgtaaatgaagatgtgactctataacctttctcttcttcctggaaaaaaaaggacattttcatgcatattttaaacagaaattttgtatatttaagtgtcatagaaaatatttattgagtaactgggacacaaatgggaatttaattgtcatcatatgctttgtgtgtggggatgcttaccaacaccatgtcgctggaccattgtggcaagccataactgcacaaagagtacacatcgtcagtgtgtgtgtgtgtgtgtgtgtgcgcgcacgcacgtgcgtgtgtgtgtccctgcatgtgcaacatgtctagcttgctgtccttcatgggattttagctttcccttcttgaaaaacattattttacagttccaggaggccctggttacattactatatgaaggcagtgatttgaaatgaaaattcctttcctcttggaagctttggtcataatatcatggttcaattaaacggattccaccggactttgtgatgaaaaaggctctgttaaaatccaattgagtttccaagaggaaattgtagtaggtcaagatgcatgagagggaagatggaggccacctcagctggagaacatgagctgagttgagccctcagtgttgaagttgacttgctccaagctgcagtctaaaaccctggggcccgtgcctggcctatgctccctcccaagtaagtagaggagcagaaccatcaggaacagcctgcctggctcctatgaagaaaacttcctgacgtcctgtccccaaaggaagaccctttccccaagggcaccccaggtggccattaaattgtgatgatcattcagaaagtgcccccttggctttatgagaatccaattagtcttctgaaccaccttttcttgggtgcagatttccaacattcatgctcattgcagatccaccaactgtcactgttcttaacaagcatgctcgtcttgtcagaatttcagtaagttccaatttcctgtacagaccagggtaaactgttctaaaatcaatcaattaatgaaatgttatctggtttttaaaagctggtttcatgtgctttatgtgtataaaactatatctgcctgtgtggctttgcatttcaaatgtgtggcgcacaagcgttttgttggtgctttgttctcagtacagtaactctgtgtacaaacattttaatgtggttttgttgttttccaacaagatgtctctgtaaaaatgatattggctgagctggtgcgttggtttctctcatagaggcattaactatactgccaatgcattgaattatttaaaaatgcaaaataaaatttttatgaaaatctca

SEQ ID NO: 300916 - DNA, 13597 bp, Homo sapiens
cgccgcctgtgcagccgctgccgccgccgccgccgccgccgccgccgccgccgccgccgccgccgctgccgccccggctgccgcgccgcgccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaagacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggaatcgcagcatctgaccccaggattcaccttacaaaagtggaatgacccaaccaccagagcttctacaaagtcagtgtctttcaaatcgatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagctatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcctgtagactgttaattacttaataatctcattgggaaaatactagtagttttatatttggatgacataattggaaaaagcagattagctgctactacttttaaaagacttaaggtcgggatgcctttttttccatgtaaggaaatgaaaagacccaaaatcttcaggcaaaaagcaagttgcaaaattagaaaccattggctaaaaatgtgttttgttgagtttccaaatggatgaattttcatttggacattacatcactaaattcattagattttgtctgcattggaaagatactcttctagcatatctttcccaaagatatctaatttggattctgtttcatgcaaatttgcatcccggaggttgaagttggagtttgaggttggaaaatatctttgaaggcagaatcagttgagttgtgagggtgaagcctcacatacttctcaacagacatgataaaattcacctgcatgagttggcaggtgggagaaccaaactggatcactgggtaagactactcagtaaagcaatgaactgcttgcttagagaagcatcactatccccattgagaaaaatgtgtggcaagatgatacagctacacagtatcaaatgaatgggtcaattcagcacccccaaatttaattctgtggggaaaaattattgagccagttgtcagtgttctgttacatgactggcagactaaattcttcatcgttgttgttattgttgttgttgtttctcattttcactcgcacggccttattctcataattaaaatctaattcattttctctttagtgttagtagactccaacaacagaagtggcatctgtgtattcataatcagcatttaccctggcaggagactaatcagataggccggtctcagacattaatcctaccatctgatatttttggtgaaggaaaaagtattaattctctttccatcctcctcctcagaaatatagaagccctctttaccaaaatcatcacattttactctgtaatctaccagctaaaagaaaattgcattgaagccccacaaagccagattgcagttcttgcccctttttgcgtctgacatgagatgttaaagaattattcatagtgctcacattgggttaggggacactgaactgctttttagatccatgatcagtcatcattcttctaagagattggagctttgctgtttcattaactgtgcagtgtagactaatggtgtttaataaaaatcattcaaaatttcaaactcttttgccagtgacctcaattttgttggctctgtgatttgtatcagactttgaggagggaagggggaagtgaaggaagcctacgtccaggcccctgacaggatgctgcagtagcaagctcaagctcgcctgcctgccagcagttgctggtgagcagcagcatgcagaccagctgtgggaagcctcctgaagaatgccccagctgatgctttcagctgggaatagtttgttcctattggggaactcattgttctccagtctctgcagcaggaagccagctgtcatattcggagggaatttcagatgctttacctttttggttttgtcctgcatcactcatgtggctacgaaagtgtctctgagaatagagcccaatgtggtgacaatgggtagtcaaatgcaccccagatgctcaagccctgttgtggttctgcagtgtttatgaaattgggaggaaggagaccctggacagtaagcaaaattggagacactccaacgaggctaagttaatgccgtgttgcccagaacaagatctagcttctcatttggtcagcctagcatgcaaccagtggtgtgctggtaaaatgtttaacaaccagctcgctgagaatagaaagcacctggtttgcaccatttgccaatttccatggcataaatactaccactttagatgattttaagctaccaactgtgatgtcactgaacacatggttggaaagagatgcacgcagttggctcttgcaagcctgggcaaaaatgcttcaacacgccactggatgcagccagtcagagggttcatatttaatatatgtgttcatgtggacacacacagacacacacacacaaactcacccttacacacacacttcgatgactaaaacaattacatagttttaagatatgaatcaatgtgtgaatgtagaaagcttatgataaggccctagaggtatgggttgccctggaagcctaggttttaagcaggagaatagctgagaagaatgaagccctcctgagctgaaaggagagatggatcaatggagatggttccatcatctccttccatatctcacaggtaaaatgggcactcagaaaaccctcacgattgattttttaaaaagataagtgagtgttttttattttattattattgtcatcattattttgatttacaaatgctatttgtaacttttacatgtaactaggataaagtatttacgggaactctatggagaatagcacaatccagaatttactgtgtttttcttttatgtgacgtggaaactcagtaattctcccaccttcacattgttgttcataagaattttactttagttattagggaatctaagttttttgttaacatttgtttttagttaaaagtatctacttactgttttagctctgaactcaaaccagaatatctctgtatcaattgcatgactattcagaaacaataatccaaaccaaaataattctttttccacccagtacgaagaaaactaagctcagtaacaagaaggcataaactaaagtatataatgaggctttcattaaatacacacacacacacactcacacacacacacatacactttttaaatttttaaattaggcctccacacataaatcattttgaaagtagaatagaaaatctcaaagaattcattctcctggtcctgtgcatcttctgcagttaataagaggtttgtatctggaaagatggaagaacttgttctaaaatcttatttttcaaaaaaaaatttccattttctctctgggcctgtatccatggttgaatgttagccctggaggagatccatgtcttactcgctctttctggcccttctgtcttttgcctctgcaattctttttgtagctggcacgatagcagggactgggggtctatcctttcatggtattgctacaatatttgtccttactggaaaatggtaacatccgggtctgatttaattggcattacacttacacagggactctgagcacccccgtcaccacaccagacagtggaccagttttcacagctacaaagagctagaaatgtgtttaacatcatccagtgcatcccctaattcaaaaccatcctcactaatcaatcatattcacccataaatattacaaatgagattgattccatctcaagacaatttgtcaaatacttaattttcttcctggatgattctacttactggatattttagaaagagaaatgtctgagataaaatccctcacatttactcaatataacaaattactgtttctactcctattctgagtagtgcttctgaagattgtttgctgtagtgttgtctttgataaaatgaatgtcagtagtgagccttttagagataccatgctcagacatcctctttgggatcagaagatacctaaaattctccccttttgcccacttggttagatgagtgatatattctttggatcctgcaaagaagagattggtttcttttcttttctggtggtggtagtggttgtatctgtggctgtgatggttgttgttacttgtctctctctctctctggctctggcttttgctttcctgctagtgttctttctctttccaaacaaatagttaaattaaacgtgagcttctgaattgtacttgttcatactttcaaaacataacagattaataaaaatagatgtgtcctgatttaaaacatgccccctggaaaggcatgctgtattatgaaatcgtgataatataactgcattattacatggcagtataaatattagtctgttgaattcatttgtccaattgtataactttgtggagcagtgttttgacctttgatacataattctggagcaagtggagtggttgcaggcagatgagacagtgttatatcaggatttttcaatcaactttagttggaggcctggcaattacaaacatcttcagatgtttctgtaaccattataaatatgaaaaaaacctcttcaaaaaatttcccatagtacttcagtcaagactttttaggtttatcttttttttttcatttctccttttccttttccattatttttcgatgggggggttgttatcattgactgaagaaatattttgattgcaatggtctctctctctctccccctctctctctctctcctctattctttcctccttccctctgtccatcacccctcattaaaatattgaaatctggagtctttgataaatctgcattagaccaggctatatgctaggaatgaaatctgggcaaatatcgatgggttttcaaagaatgctccatgttcattgggccctttcacaccccacagtgataaatgaaaaggatagaggtagttttttcaaaagagcactttaataatatcctctgagacctaatgcagtttaacaaatgactccacctatttttccagtaggtaaattgactgagacttgcaaaatacccctgagagttgtcaggggtgtcttctgcctggtctatagcgtgtgtgtttgctttgtatctaacaggcacattcacgtctcgtgtactcatatgaagtatttcctaacattcccattagcctgtatataagaatcagaaagataatcccaacatgttgtaaatgaagatgtgactctataacctttctcttcttcctggaaaaaaaaggacattttcatgcatattttaaacagaaattttgtatatttaagtgtcatagaaaatatttattgagtaactgggacacaaatgggaatttaattgtcatcatatgctttgtgtgtggggatgcttaccaacaccatgtcgctggaccattgtggcaagccataactgcacaaagagtacacatcgtcagtgtgtgtgtgtgtgtgtgtgtgcgcgcacgcacgtgcgtgtgtgtgtccctgcatgtgcaacatgtctagcttgctgtccttcatgggattttagctttcccttcttgaaaaacattattttacagttccaggaggccctggttacattactatatgaaggcagtgatttgaaatgaaaattcctttcctcttggaagctttggtcataatatcatggttcaattaaacggattccaccggactttgtgatgaaaaaggctctgttaaaatccaattgagtttccaagaggaaattgtagtaggtcaagatgcatgagagggaagatggaggccacctcagctggagaacatgagctgagttgagccctcagtgttgaagttgacttgctccaagctgcagtctaaaaccctggggcccgtgcctggcctatgctccctcccaagtaagtagaggagcagaaccatcaggaacagcctgcctggctcctatgaagaaaacttcctgacgtcctgtccccaaaggaagaccctttccccaagggcaccccaggtggccattaaattgtgatgatcattcagaaagtgcccccttggctttatgagaatccaattagtcttctgaaccaccttttcttgggtgcagatttccaacattcatgctcattgcagatccaccaactgtcactgttcttaacaagcatgctcgtcttgtcagaatttcagtaagttccaatttcctgtacagaccagggtaaactgttctaaaatcaatcaattaatgaaatgttatctggtttttaaaagctggtttcatgtgctttatgtgtataaaactatatctgcctgtgtggctttgcatttcaaatgtgtggcgcacaagcgttttgttggtgctttgttctcagtacagtaactctgtgtacaaacattttaatgtggttttgttgttttccaacaagatgtctctgtaaaaatgatattggctgagctggtgcgttggtttctctcatagaggcattaactatactgccaatgcattgaattatttaaaaatgcaaaataaaatttttatgaaaatctca

SEQ ID NO: 300917 - DNA, 13579 bp, Homo sapiens
cgccgcctgtgcagccgctgccgccgccgccgccgccgccgccgccgccgccgccgccgccgccgctgccgccccggctgccgcgccgcgccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtgtcactatgaacaagaccgtagtgcacttaaaaaaagggaatgggagcggaggaatcaagaagtccagcaagaagacgatctcttttcttcaggctttgatctttttggggagccatacaagacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggaatcgcagcatctgaccccaggattcaccttacaaaagtggaatgacccaaccaccagagcttctacaaagatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagctatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcctgtagactgttaattacttaataatctcattgggaaaatactagtagttttatatttggatgacataattggaaaaagcagattagctgctactacttttaaaagacttaaggtcgggatgcctttttttccatgtaaggaaatgaaaagacccaaaatcttcaggcaaaaagcaagttgcaaaattagaaaccattggctaaaaatgtgttttgttgagtttccaaatggatgaattttcatttggacattacatcactaaattcattagattttgtctgcattggaaagatactcttctagcatatctttcccaaagatatctaatttggattctgtttcatgcaaatttgcatcccggaggttgaagttggagtttgaggttggaaaatatctttgaaggcagaatcagttgagttgtgagggtgaagcctcacatacttctcaacagacatgataaaattcacctgcatgagttggcaggtgggagaaccaaactggatcactgggtaagactactcagtaaagcaatgaactgcttgcttagagaagcatcactatccccattgagaaaaatgtgtggcaagatgatacagctacacagtatcaaatgaatgggtcaattcagcacccccaaatttaattctgtggggaaaaattattgagccagttgtcagtgttctgttacatgactggcagactaaattcttcatcgttgttgttattgttgttgttgtttctcattttcactcgcacggccttattctcataattaaaatctaattcattttctctttagtgttagtagactccaacaacagaagtggcatctgtgtattcataatcagcatttaccctggcaggagactaatcagataggccggtctcagacattaatcctaccatctgatatttttggtgaaggaaaaagtattaattctctttccatcctcctcctcagaaatatagaagccctctttaccaaaatcatcacattttactctgtaatctaccagctaaaagaaaattgcattgaagccccacaaagccagattgcagttcttgcccctttttgcgtctgacatgagatgttaaagaattattcatagtgctcacattgggttaggggacactgaactgctttttagatccatgatcagtcatcattcttctaagagattggagctttgctgtttcattaactgtgcagtgtagactaatggtgtttaataaaaatcattcaaaatttcaaactcttttgccagtgacctcaattttgttggctctgtgatttgtatcagactttgaggagggaagggggaagtgaaggaagcctacgtccaggcccctgacaggatgctgcagtagcaagctcaagctcgcctgcctgccagcagttgctggtgagcagcagcatgcagaccagctgtgggaagcctcctgaagaatgccccagctgatgctttcagctgggaatagtttgttcctattggggaactcattgttctccagtctctgcagcaggaagccagctgtcatattcggagggaatttcagatgctttacctttttggttttgtcctgcatcactcatgtggctacgaaagtgtctctgagaatagagcccaatgtggtgacaatgggtagtcaaatgcaccccagatgctcaagccctgttgtggttctgcagtgtttatgaaattgggaggaaggagaccctggacagtaagcaaaattggagacactccaacgaggctaagttaatgccgtgttgcccagaacaagatctagcttctcatttggtcagcctagcatgcaaccagtggtgtgctggtaaaatgtttaacaaccagctcgctgagaatagaaagcacctggtttgcaccatttgccaatttccatggcataaatactaccactttagatgattttaagctaccaactgtgatgtcactgaacacatggttggaaagagatgcacgcagttggctcttgcaagcctgggcaaaaatgcttcaacacgccactggatgcagccagtcagagggttcatatttaatatatgtgttcatgtggacacacacagacacacacacacaaactcacccttacacacacacttcgatgactaaaacaattacatagttttaagatatgaatcaatgtgtgaatgtagaaagcttatgataaggccctagaggtatgggttgccctggaagcctaggttttaagcaggagaatagctgagaagaatgaagccctcctgagctgaaaggagagatggatcaatggagatggttccatcatctccttccatatctcacaggtaaaatgggcactcagaaaaccctcacgattgattttttaaaaagataagtgagtgttttttattttattattattgtcatcattattttgatttacaaatgctatttgtaacttttacatgtaactaggataaagtatttacgggaactctatggagaatagcacaatccagaatttactgtgtttttcttttatgtgacgtggaaactcagtaattctcccaccttcacattgttgttcataagaattttactttagttattagggaatctaagttttttgttaacatttgtttttagttaaaagtatctacttactgttttagctctgaactcaaaccagaatatctctgtatcaattgcatgactattcagaaacaataatccaaaccaaaataattctttttccacccagtacgaagaaaactaagctcagtaacaagaaggcataaactaaagtatataatgaggctttcattaaatacacacacacacacactcacacacacacacatacactttttaaatttttaaattaggcctccacacataaatcattttgaaagtagaatagaaaatctcaaagaattcattctcctggtcctgtgcatcttctgcagttaataagaggtttgtatctggaaagatggaagaacttgttctaaaatcttatttttcaaaaaaaaatttccattttctctctgggcctgtatccatggttgaatgttagccctggaggagatccatgtcttactcgctctttctggcccttctgtcttttgcctctgcaattctttttgtagctggcacgatagcagggactgggggtctatcctttcatggtattgctacaatatttgtccttactggaaaatggtaacatccgggtctgatttaattggcattacacttacacagggactctgagcacccccgtcaccacaccagacagtggaccagttttcacagctacaaagagctagaaatgtgtttaacatcatccagtgcatcccctaattcaaaaccatcctcactaatcaatcatattcacccataaatattacaaatgagattgattccatctcaagacaatttgtcaaatacttaattttcttcctggatgattctacttactggatattttagaaagagaaatgtctgagataaaatccctcacatttactcaatataacaaattactgtttctactcctattctgagtagtgcttctgaagattgtttgctgtagtgttgtctttgataaaatgaatgtcagtagtgagccttttagagataccatgctcagacatcctctttgggatcagaagatacctaaaattctccccttttgcccacttggttagatgagtgatatattctttggatcctgcaaagaagagattggtttcttttcttttctggtggtggtagtggttgtatctgtggctgtgatggttgttgttacttgtctctctctctctctggctctggcttttgctttcctgctagtgttctttctctttccaaacaaatagttaaattaaacgtgagcttctgaattgtacttgttcatactttcaaaacataacagattaataaaaatagatgtgtcctgatttaaaacatgccccctggaaaggcatgctgtattatgaaatcgtgataatataactgcattattacatggcagtataaatattagtctgttgaattcatttgtccaattgtataactttgtggagcagtgttttgacctttgatacataattctggagcaagtggagtggttgcaggcagatgagacagtgttatatcaggatttttcaatcaactttagttggaggcctggcaattacaaacatcttcagatgtttctgtaaccattataaatatgaaaaaaacctcttcaaaaaatttcccatagtacttcagtcaagactttttaggtttatcttttttttttcatttctccttttccttttccattatttttcgatgggggggttgttatcattgactgaagaaatattttgattgcaatggtctctctctctctccccctctctctctctctcctctattctttcctccttccctctgtccatcacccctcattaaaatattgaaatctggagtctttgataaatctgcattagaccaggctatatgctaggaatgaaatctgggcaaatatcgatgggttttcaaagaatgctccatgttcattgggccctttcacaccccacagtgataaatgaaaaggatagaggtagttttttcaaaagagcactttaataatatcctctgagacctaatgcagtttaacaaatgactccacctatttttccagtaggtaaattgactgagacttgcaaaatacccctgagagttgtcaggggtgtcttctgcctggtctatagcgtgtgtgtttgctttgtatctaacaggcacattcacgtctcgtgtactcatatgaagtatttcctaacattcccattagcctgtatataagaatcagaaagataatcccaacatgttgtaaatgaagatgtgactctataacctttctcttcttcctggaaaaaaaaggacattttcatgcatattttaaacagaaattttgtatatttaagtgtcatagaaaatatttattgagtaactgggacacaaatgggaatttaattgtcatcatatgctttgtgtgtggggatgcttaccaacaccatgtcgctggaccattgtggcaagccataactgcacaaagagtacacatcgtcagtgtgtgtgtgtgtgtgtgtgtgcgcgcacgcacgtgcgtgtgtgtgtccctgcatgtgcaacatgtctagcttgctgtccttcatgggattttagctttcccttcttgaaaaacattattttacagttccaggaggccctggttacattactatatgaaggcagtgatttgaaatgaaaattcctttcctcttggaagctttggtcataatatcatggttcaattaaacggattccaccggactttgtgatgaaaaaggctctgttaaaatccaattgagtttccaagaggaaattgtagtaggtcaagatgcatgagagggaagatggaggccacctcagctggagaacatgagctgagttgagccctcagtgttgaagttgacttgctccaagctgcagtctaaaaccctggggcccgtgcctggcctatgctccctcccaagtaagtagaggagcagaaccatcaggaacagcctgcctggctcctatgaagaaaacttcctgacgtcctgtccccaaaggaagaccctttccccaagggcaccccaggtggccattaaattgtgatgatcattcagaaagtgcccccttggctttatgagaatccaattagtcttctgaaccaccttttcttgggtgcagatttccaacattcatgctcattgcagatccaccaactgtcactgttcttaacaagcatgctcgtcttgtcagaatttcagtaagttccaatttcctgtacagaccagggtaaactgttctaaaatcaatcaattaatgaaatgttatctggtttttaaaagctggtttcatgtgctttatgtgtataaaactatatctgcctgtgtggctttgcatttcaaatgtgtggcgcacaagcgttttgttggtgctttgttctcagtacagtaactctgtgtacaaacattttaatgtggttttgttgttttccaacaagatgtctctgtaaaaatgatattggctgagctggtgcgttggtttctctcatagaggcattaactatactgccaatgcattgaattatttaaaaatgcaaaataaaatttttatgaaaatctca

SEQ ID NO: 300918 - DNA, 13213 bp, Homo sapiens
agagccgactgcatacgtcagacccacggatggccaggaccaggcaccggacatctcaccaacactgaaaccttcaattgaatttgagaacagctttgggaatctgtcatttggaacactcttggatggaaaacccagtgcacccagttcaaaagactaaactgccaaagttcaccatcctccaaacaagtgaaacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgggaatctgtcatttggaacactcttggatggaaaacccagtgcagccagttcaaagactaaactgccaaagttcaccatcctccaaacaagtgaagtaagccttcccagtgatccaagctgtgttgaagaaatcttgcgggagatgacccattcctggcctactcctctcacttccatgcatactgctggacactctgagcagagcaccttttccatcccaggacaggaatcgcagcatctgaccccaggattcaccttacaaaagtggaatgacccaaccaccagagcttctacaaagatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagctatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcctgtagactgttaattacttaataatctcattgggaaaatactagtagttttatatttggatgacataattggaaaaagcagattagctgctactacttttaaaagacttaaggtcgggatgcctttttttccatgtaaggaaatgaaaagacccaaaatcttcaggcaaaaagcaagttgcaaaattagaaaccattggctaaaaatgtgttttgttgagtttccaaatggatgaattttcatttggacattacatcactaaattcattagattttgtctgcattggaaagatactcttctagcatatctttcccaaagatatctaatttggattctgtttcatgcaaatttgcatcccggaggttgaagttggagtttgaggttggaaaatatctttgaaggcagaatcagttgagttgtgagggtgaagcctcacatacttctcaacagacatgataaaattcacctgcatgagttggcaggtgggagaaccaaactggatcactgggtaagactactcagtaaagcaatgaactgcttgcttagagaagcatcactatccccattgagaaaaatgtgtggcaagatgatacagctacacagtatcaaatgaatgggtcaattcagcacccccaaatttaattctgtggggaaaaattattgagccagttgtcagtgttctgttacatgactggcagactaaattcttcatcgttgttgttattgttgttgttgtttctcattttcactcgcacggccttattctcataattaaaatctaattcattttctctttagtgttagtagactccaacaacagaagtggcatctgtgtattcataatcagcatttaccctggcaggagactaatcagataggccggtctcagacattaatcctaccatctgatatttttggtgaaggaaaaagtattaattctctttccatcctcctcctcagaaatatagaagccctctttaccaaaatcatcacattttactctgtaatctaccagctaaaagaaaattgcattgaagccccacaaagccagattgcagttcttgcccctttttgcgtctgacatgagatgttaaagaattattcatagtgctcacattgggttaggggacactgaactgctttttagatccatgatcagtcatcattcttctaagagattggagctttgctgtttcattaactgtgcagtgtagactaatggtgtttaataaaaatcattcaaaatttcaaactcttttgccagtgacctcaattttgttggctctgtgatttgtatcagactttgaggagggaagggggaagtgaaggaagcctacgtccaggcccctgacaggatgctgcagtagcaagctcaagctcgcctgcctgccagcagttgctggtgagcagcagcatgcagaccagctgtgggaagcctcctgaagaatgccccagctgatgctttcagctgggaatagtttgttcctattggggaactcattgttctccagtctctgcagcaggaagccagctgtcatattcggagggaatttcagatgctttacctttttggttttgtcctgcatcactcatgtggctacgaaagtgtctctgagaatagagcccaatgtggtgacaatgggtagtcaaatgcaccccagatgctcaagccctgttgtggttctgcagtgtttatgaaattgggaggaaggagaccctggacagtaagcaaaattggagacactccaacgaggctaagttaatgccgtgttgcccagaacaagatctagcttctcatttggtcagcctagcatgcaaccagtggtgtgctggtaaaatgtttaacaaccagctcgctgagaatagaaagcacctggtttgcaccatttgccaatttccatggcataaatactaccactttagatgattttaagctaccaactgtgatgtcactgaacacatggttggaaagagatgcacgcagttggctcttgcaagcctgggcaaaaatgcttcaacacgccactggatgcagccagtcagagggttcatatttaatatatgtgttcatgtggacacacacagacacacacacacaaactcacccttacacacacacttcgatgactaaaacaattacatagttttaagatatgaatcaatgtgtgaatgtagaaagcttatgataaggccctagaggtatgggttgccctggaagcctaggttttaagcaggagaatagctgagaagaatgaagccctcctgagctgaaaggagagatggatcaatggagatggttccatcatctccttccatatctcacaggtaaaatgggcactcagaaaaccctcacgattgattttttaaaaagataagtgagtgttttttattttattattattgtcatcattattttgatttacaaatgctatttgtaacttttacatgtaactaggataaagtatttacgggaactctatggagaatagcacaatccagaatttactgtgtttttcttttatgtgacgtggaaactcagtaattctcccaccttcacattgttgttcataagaattttactttagttattagggaatctaagttttttgttaacatttgtttttagttaaaagtatctacttactgttttagctctgaactcaaaccagaatatctctgtatcaattgcatgactattcagaaacaataatccaaaccaaaataattctttttccacccagtacgaagaaaactaagctcagtaacaagaaggcataaactaaagtatataatgaggctttcattaaatacacacacacacacactcacacacacacacatacactttttaaatttttaaattaggcctccacacataaatcattttgaaagtagaatagaaaatctcaaagaattcattctcctggtcctgtgcatcttctgcagttaataagaggtttgtatctggaaagatggaagaacttgttctaaaatcttatttttcaaaaaaaaatttccattttctctctgggcctgtatccatggttgaatgttagccctggaggagatccatgtcttactcgctctttctggcccttctgtcttttgcctctgcaattctttttgtagctggcacgatagcagggactgggggtctatcctttcatggtattgctacaatatttgtccttactggaaaatggtaacatccgggtctgatttaattggcattacacttacacagggactctgagcacccccgtcaccacaccagacagtggaccagttttcacagctacaaagagctagaaatgtgtttaacatcatccagtgcatcccctaattcaaaaccatcctcactaatcaatcatattcacccataaatattacaaatgagattgattccatctcaagacaatttgtcaaatacttaattttcttcctggatgattctacttactggatattttagaaagagaaatgtctgagataaaatccctcacatttactcaatataacaaattactgtttctactcctattctgagtagtgcttctgaagattgtttgctgtagtgttgtctttgataaaatgaatgtcagtagtgagccttttagagataccatgctcagacatcctctttgggatcagaagatacctaaaattctccccttttgcccacttggttagatgagtgatatattctttggatcctgcaaagaagagattggtttcttttcttttctggtggtggtagtggttgtatctgtggctgtgatggttgttgttacttgtctctctctctctctggctctggcttttgctttcctgctagtgttctttctctttccaaacaaatagttaaattaaacgtgagcttctgaattgtacttgttcatactttcaaaacataacagattaataaaaatagatgtgtcctgatttaaaacatgccccctggaaaggcatgctgtattatgaaatcgtgataatataactgcattattacatggcagtataaatattagtctgttgaattcatttgtccaattgtataactttgtggagcagtgttttgacctttgatacataattctggagcaagtggagtggttgcaggcagatgagacagtgttatatcaggatttttcaatcaactttagttggaggcctggcaattacaaacatcttcagatgtttctgtaaccattataaatatgaaaaaaacctcttcaaaaaatttcccatagtacttcagtcaagactttttaggtttatcttttttttttcatttctccttttccttttccattatttttcgatgggggggttgttatcattgactgaagaaatattttgattgcaatggtctctctctctctccccctctctctctctctcctctattctttcctccttccctctgtccatcacccctcattaaaatattgaaatctggagtctttgataaatctgcattagaccaggctatatgctaggaatgaaatctgggcaaatatcgatgggttttcaaagaatgctccatgttcattgggccctttcacaccccacagtgataaatgaaaaggatagaggtagttttttcaaaagagcactttaataatatcctctgagacctaatgcagtttaacaaatgactccacctatttttccagtaggtaaattgactgagacttgcaaaatacccctgagagttgtcaggggtgtcttctgcctggtctatagcgtgtgtgtttgctttgtatctaacaggcacattcacgtctcgtgtactcatatgaagtatttcctaacattcccattagcctgtatataagaatcagaaagataatcccaacatgttgtaaatgaagatgtgactctataacctttctcttcttcctggaaaaaaaaggacattttcatgcatattttaaacagaaattttgtatatttaagtgtcatagaaaatatttattgagtaactgggacacaaatgggaatttaattgtcatcatatgctttgtgtgtggggatgcttaccaacaccatgtcgctggaccattgtggcaagccataactgcacaaagagtacacatcgtcagtgtgtgtgtgtgtgtgtgtgtgcgcgcacgcacgtgcgtgtgtgtgtccctgcatgtgcaacatgtctagcttgctgtccttcatgggattttagctttcccttcttgaaaaacattattttacagttccaggaggccctggttacattactatatgaaggcagtgatttgaaatgaaaattcctttcctcttggaagctttggtcataatatcatggttcaattaaacggattccaccggactttgtgatgaaaaaggctctgttaaaatccaattgagtttccaagaggaaattgtagtaggtcaagatgcatgagagggaagatggaggccacctcagctggagaacatgagctgagttgagccctcagtgttgaagttgacttgctccaagctgcagtctaaaaccctggggcccgtgcctggcctatgctccctcccaagtaagtagaggagcagaaccatcaggaacagcctgcctggctcctatgaagaaaacttcctgacgtcctgtccccaaaggaagaccctttccccaagggcaccccaggtggccattaaattgtgatgatcattcagaaagtgcccccttggctttatgagaatccaattagtcttctgaaccaccttttcttgggtgcagatttccaacattcatgctcattgcagatccaccaactgtcactgttcttaacaagcatgctcgtcttgtcagaatttcagtaagttccaatttcctgtacagaccagggtaaactgttctaaaatcaatcaattaatgaaatgttatctggtttttaaaagctggtttcatgtgctttatgtgtataaaactatatctgcctgtgtggctttgcatttcaaatgtgtggcgcacaagcgttttgttggtgctttgttctcagtacagtaactctgtgtacaaacattttaatgtggttttgttgttttccaacaagatgtctctgtaaaaatgatattggctgagctggtgcgttggtttctctcatagaggcattaactatactgccaatgcattgaattatttaaaaatgcaaaataaaatttttatgaaaatctca

SEQ ID NO: 300919 - DNA, 11293 bp, Homo sapiens
tgtatccagacatggacagagctgattacccgccgactgcatacagacatggacagagctggcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagctatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcctgtagactgttaattacttaataatctcattgggaaaatactagtagttttatatttggatgacataattggaaaaagcagattagctgctactacttttaaaagacttaaggtcgggatgcctttttttccatgtaaggaaatgaaaagacccaaaatcttcaggcaaaaagcaagttgcaaaattagaaaccattggctaaaaatgtgttttgttgagtttccaaatggatgaattttcatttggacattacatcactaaattcattagattttgtctgcattggaaagatactcttctagcatatctttcccaaagatatctaatttggattctgtttcatgcaaatttgcatcccggaggttgaagttggagtttgaggttggaaaatatctttgaaggcagaatcagttgagttgtgagggtgaagcctcacatacttctcaacagacatgataaaattcacctgcatgagttggcaggtgggagaaccaaactggatcactgggtaagactactcagtaaagcaatgaactgcttgcttagagaagcatcactatccccattgagaaaaatgtgtggcaagatgatacagctacacagtatcaaatgaatgggtcaattcagcacccccaaatttaattctgtggggaaaaattattgagccagttgtcagtgttctgttacatgactggcagactaaattcttcatcgttgttgttattgttgttgttgtttctcattttcactcgcacggccttattctcataattaaaatctaattcattttctctttagtgttagtagactccaacaacagaagtggcatctgtgtattcataatcagcatttaccctggcaggagactaatcagataggccggtctcagacattaatcctaccatctgatatttttggtgaaggaaaaagtattaattctctttccatcctcctcctcagaaatatagaagccctctttaccaaaatcatcacattttactctgtaatctaccagctaaaagaaaattgcattgaagccccacaaagccagattgcagttcttgcccctttttgcgtctgacatgagatgttaaagaattattcatagtgctcacattgggttaggggacactgaactgctttttagatccatgatcagtcatcattcttctaagagattggagctttgctgtttcattaactgtgcagtgtagactaatggtgtttaataaaaatcattcaaaatttcaaactcttttgccagtgacctcaattttgttggctctgtgatttgtatcagactttgaggagggaagggggaagtgaaggaagcctacgtccaggcccctgacaggatgctgcagtagcaagctcaagctcgcctgcctgccagcagttgctggtgagcagcagcatgcagaccagctgtgggaagcctcctgaagaatgccccagctgatgctttcagctgggaatagtttgttcctattggggaactcattgttctccagtctctgcagcaggaagccagctgtcatattcggagggaatttcagatgctttacctttttggttttgtcctgcatcactcatgtggctacgaaagtgtctctgagaatagagcccaatgtggtgacaatgggtagtcaaatgcaccccagatgctcaagccctgttgtggttctgcagtgtttatgaaattgggaggaaggagaccctggacagtaagcaaaattggagacactccaacgaggctaagttaatgccgtgttgcccagaacaagatctagcttctcatttggtcagcctagcatgcaaccagtggtgtgctggtaaaatgtttaacaaccagctcgctgagaatagaaagcacctggtttgcaccatttgccaatttccatggcataaatactaccactttagatgattttaagctaccaactgtgatgtcactgaacacatggttggaaagagatgcacgcagttggctcttgcaagcctgggcaaaaatgcttcaacacgccactggatgcagccagtcagagggttcatatttaatatatgtgttcatgtggacacacacagacacacacacacaaactcacccttacacacacacttcgatgactaaaacaattacatagttttaagatatgaatcaatgtgtgaatgtagaaagcttatgataaggccctagaggtatgggttgccctggaagcctaggttttaagcaggagaatagctgagaagaatgaagccctcctgagctgaaaggagagatggatcaatggagatggttccatcatctccttccatatctcacaggtaaaatgggcactcagaaaaccctcacgattgattttttaaaaagataagtgagtgttttttattttattattattgtcatcattattttgatttacaaatgctatttgtaacttttacatgtaactaggataaagtatttacgggaactctatggagaatagcacaatccagaatttactgtgtttttcttttatgtgacgtggaaactcagtaattctcccaccttcacattgttgttcataagaattttactttagttattagggaatctaagttttttgttaacatttgtttttagttaaaagtatctacttactgttttagctctgaactcaaaccagaatatctctgtatcaattgcatgactattcagaaacaataatccaaaccaaaataattctttttccacccagtacgaagaaaactaagctcagtaacaagaaggcataaactaaagtatataatgaggctttcattaaatacacacacacacacactcacacacacacacatacactttttaaatttttaaattaggcctccacacataaatcattttgaaagtagaatagaaaatctcaaagaattcattctcctggtcctgtgcatcttctgcagttaataagaggtttgtatctggaaagatggaagaacttgttctaaaatcttatttttcaaaaaaaaatttccattttctctctgggcctgtatccatggttgaatgttagccctggaggagatccatgtcttactcgctctttctggcccttctgtcttttgcctctgcaattctttttgtagctggcacgatagcagggactgggggtctatcctttcatggtattgctacaatatttgtccttactggaaaatggtaacatccgggtctgatttaattggcattacacttacacagggactctgagcacccccgtcaccacaccagacagtggaccagttttcacagctacaaagagctagaaatgtgtttaacatcatccagtgcatcccctaattcaaaaccatcctcactaatcaatcatattcacccataaatattacaaatgagattgattccatctcaagacaatttgtcaaatacttaattttcttcctggatgattctacttactggatattttagaaagagaaatgtctgagataaaatccctcacatttactcaatataacaaattactgtttctactcctattctgagtagtgcttctgaagattgtttgctgtagtgttgtctttgataaaatgaatgtcagtagtgagccttttagagataccatgctcagacatcctctttgggatcagaagatacctaaaattctccccttttgcccacttggttagatgagtgatatattctttggatcctgcaaagaagagattggtttcttttcttttctggtggtggtagtggttgtatctgtggctgtgatggttgttgttacttgtctctctctctctctggctctggcttttgctttcctgctagtgttctttctctttccaaacaaatagttaaattaaacgtgagcttctgaattgtacttgttcatactttcaaaacataacagattaataaaaatagatgtgtcctgatttaaaacatgccccctggaaaggcatgctgtattatgaaatcgtgataatataactgcattattacatggcagtataaatattagtctgttgaattcatttgtccaattgtataactttgtggagcagtgttttgacctttgatacataattctggagcaagtggagtggttgcaggcagatgagacagtgttatatcaggatttttcaatcaactttagttggaggcctggcaattacaaacatcttcagatgtttctgtaaccattataaatatgaaaaaaacctcttcaaaaaatttcccatagtacttcagtcaagactttttaggtttatcttttttttttcatttctccttttccttttccattatttttcgatgggggggttgttatcattgactgaagaaatattttgattgcaatggtctctctctctctccccctctctctctctctcctctattctttcctccttccctctgtccatcacccctcattaaaatattgaaatctggagtctttgataaatctgcattagaccaggctatatgctaggaatgaaatctgggcaaatatcgatgggttttcaaagaatgctccatgttcattgggccctttcacaccccacagtgataaatgaaaaggatagaggtagttttttcaaaagagcactttaataatatcctctgagacctaatgcagtttaacaaatgactccacctatttttccagtaggtaaattgactgagacttgcaaaatacccctgagagttgtcaggggtgtcttctgcctggtctatagcgtgtgtgtttgctttgtatctaacaggcacattcacgtctcgtgtactcatatgaagtatttcctaacattcccattagcctgtatataagaatcagaaagataatcccaacatgttgtaaatgaagatgtgactctataacctttctcttcttcctggaaaaaaaaggacattttcatgcatattttaaacagaaattttgtatatttaagtgtcatagaaaatatttattgagtaactgggacacaaatgggaatttaattgtcatcatatgctttgtgtgtggggatgcttaccaacaccatgtcgctggaccattgtggcaagccataactgcacaaagagtacacatcgtcagtgtgtgtgtgtgtgtgtgtgtgcgcgcacgcacgtgcgtgtgtgtgtccctgcatgtgcaacatgtctagcttgctgtccttcatgggattttagctttcccttcttgaaaaacattattttacagttccaggaggccctggttacattactatatgaaggcagtgatttgaaatgaaaattcctttcctcttggaagctttggtcataatatcatggttcaattaaacggattccaccggactttgtgatgaaaaaggctctgttaaaatccaattgagtttccaagaggaaattgtagtaggtcaagatgcatgagagggaagatggaggccacctcagctggagaacatgagctgagttgagccctcagtgttgaagttgacttgctccaagctgcagtctaaaaccctggggcccgtgcctggcctatgctccctcccaagtaagtagaggagcagaaccatcaggaacagcctgcctggctcctatgaagaaaacttcctgacgtcctgtccccaaaggaagaccctttccccaagggcaccccaggtggccattaaattgtgatgatcattcagaaagtgcccccttggctttatgagaatccaattagtcttctgaaccaccttttcttgggtgcagatttccaacattcatgctcattgcagatccaccaactgtcactgttcttaacaagcatgctcgtcttgtcagaatttcagtaagttccaatttcctgtacagaccagggtaaactgttctaaaatcaatcaattaatgaaatgttatctggtttttaaaagctggtttcatgtgctttatgtgtataaaactatatctgcctgtgtggctttgcatttcaaatgtgtggcgcacaagcgttttgttggtgctttgttctcagtacagtaactctgtgtacaaacattttaatgtggttttgttgttttccaacaagatgtctctgtaaaaatgatattggctgagctggtgcgttggtttctctcatagaggcattaactatactgccaatgcattgaattatttaaaaatgcaaaataaaatttttatgaaaatctca

SEQ ID NO: 300920 - DNA, 370 bp, Homo sapiens
tttgtttgatctatttggacaactgtaatggttggggttggagcatgtggttatttatcctaatgggccattatgtacttcagatttcatttacagtattatttcaaggttggttatgatatgaatgacagcattagtctgcctttttcaaggcattatatgggaataaatttatagcagaaaaggtttgatgattcagtcttttactgaaaagatgaagcattggtttctgaaagagcttgttttgtttatttagggttcacaatgctgattattacatgcaagaagctaagaagctgaagcacaaagctgatgcactggtaagtttcctttttctcattgctttgttcctattaaggatttatgtttc

SEQ ID NO: 300921 - DNA, 2123 bp, Homo sapiens
accggcccagcgactctcccgggctgccagccgggacgcgcggccgccgccgctgcagacgacgagtccgccctcgtcccgcgcccccggggctcgcggagccaggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccatgcatgtgggccgtggcggggatgtcttcggggacacgtccttcctcagcaaccacggtggcagctccgggagcacccatcgctcaccccgcagcttcctggccaagaagctgcagctggtgcggagggtgggggcgcccccccggaggatggcatctccccctgcaccctccccggctccaccggccatctcccccatcatcaagaacgccatctccctgccccagctcaaccaggccgcctacgacagcctcgtggttggcaagctcagcttcgacagcagccccaccagctccacggacggccactccagctacggcctggactctgggttctgcaccatctcccgcctgccccgctcggaaaagccgcatgaccgagaccgggatggttccttcccctctgagcccgggcttcgccgctctgactctctcttgtccttccgcctggacctcgaccttgggccctcactcctcagcgagctgctaggggtcatgagcctgccagaagcccctgcagctgagactccagcccccgctgcaaaccccccagcccctactgcaaaccccacgggtcctgctgcaaaccccccagccactactgcaaaccccccagcgcctgccgcaacccccacgggtcctgctgcaaatcccccagcccctgccgcaagctccacaccccatggacactgtcccaatggggtaacagctgggttgggcccagtggctgaggtgaagtccagcccagtgggagggggtccccgaggacctgctggccctgccctcggcaggcactggggagcaggctgggatggcggccaccactacccagagatggatgcgcggcaggagcgggtggaggtgctgccccaagcccgggcctcctgggagagcctggacgaagagtggagggcgccccaggcaggcagcaggaccccagtgcccagcacagtgcaagcaaacacctttgaatttgcggatgctgaggaggatgatgaggtcaaggtgtgaggggctggggcacggtcccagggccccacctaggtgcagagccggcccctcacctaacagctggttcctaccagaccggagaggggagaagtcatgttgcccctaaacccctccccacctctgcaggacagacatgggagggaggacagggaaggccaggcttgctctgggacttttatgctcccagaggccctgccaaactgaccacctcccccgactgccactctggacctaatagctgttccttaggccccactccatgccacccccaccagctggaggacccagcctcacagtgtgtcctttgtgccagaccaagcggcccgtggggggtggggggcagggagtgtaccacacagggccattgtctcacctcccaaagggaccgcctgcccccagctcatcccagagcgtccctgctgcaaccctgacagccgtctcccaggccgcttccccaacatccccgccccagcctccctcttaccccagaaaggtcaggtatgacctcccggggaggaatcccacctgcctgtataccccagacttgcctctggggcctgattaaataaggctgttttgataaaa

SEQ ID NO: 300922 - DNA, 2144 bp, Homo sapiens
accggcccagcgactctcccgggctgccagccgggacgcgcggccgccgccgctgcagacgacgagtccgccctcgtcccgcgcccccggggctcgcggagccaggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccatgcatgtgggccgtggcggggatgtcttcggggacacgtccttcctcagcaaccacggtggcagctccgggagcacccatcgctcaccccgcagcttcctggccaagaagctgcagctggtgcggagggtgggggcgcccccccggaggatggcatctccccctgcaccctccccggctccaccggccatctcccccatcatcaagaacgccatctccctgccccagctcaaccaggccgcctacgacagcctcgtggttggcaagctcagcttcgacagcagccccaccagctccacggacggccactccagctacggcctggactctgggttctgcaccatctcccgcctgccccgctcggaaaagccgcatgaccgagaccgggatggttccttcccctctgagcccgggcttcgccgctctgactctctcttgtccttccgcctggacctcgaccttgggccctcactcctcagcgagctgctaggggtcatgagcctgccagaagcccctgcagctgagactccagcccccgctgcaaaccccccagcccctactgcaaaccccacgggtcctgctgcaaaccccccagccactactgcaaaccccccagcgcctgctgcaaacccctcagcacctgccgcaacccccacgggtcctgctgcaaatcccccagcccctgccgcaagctccacaccccatggacactgtcccaatggggtaacagctgggttgggcccagtggctgaggtgaagtccagcccagtgggagggggtccccgaggacctgctggccctgccctcggcaggcactggggagcaggctgggatggcggccaccactacccagagatggatgcgcggcaggagcgggtggaggtgctgccccaagcccgggcctcctgggagagcctggacgaagagtggagggcgccccaggcaggcagcaggaccccagtgcccagcacagtgcaagcaaacacctttgaatttgcggatgctgaggaggatgatgaggtcaaggtgtgaggggctggggcacggtcccagggccccacctaggtgcagagccggcccctcacctaacagctggttcctaccagaccggagaggggagaagtcatgttgcccctaaacccctccccacctctgcaggacagacatgggagggaggacagggaaggccaggcttgctctgggacttttatgctcccagaggccctgccaaactgaccacctcccccgactgccactctggacctaatagctgttccttaggccccactccatgccacccccaccagctggaggacccagcctcacagtgtgtcctttgtgccagaccaagcggcccgtggggggtggggggcagggagtgtaccacacagggccattgtctcacctcccaaagggaccgcctgcccccagctcatcccagagcgtccctgctgcaaccctgacagccgtctcccaggccgcttccccaacatccccgccccagcctccctcttaccccagaaaggtcaggtatgacctcccggggaggaatcccacctgcctgtataccccagacttgcctctggggcctgattaaataaggctgttttgataaaa

SEQ ID NO: 300923 - DNA, 1352 bp, Homo sapiens
accggcccagcgactctcccgggctgccagccgggacgcgcggccgccgccgctgcagacgacgagtccgccctcgtcccgcgcccccggggctcgcggagccaggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccatgcatgtgggccgtggcggggatgtcttcggggacacgtccttcctcagcaaccacggtggcagctccgggagcacccatcgctcaccccgcagcttcctggccaagaagctgcagctggtgcggagggtgggggcgcccccccggaggatggcatctccccctgcaccctccccggctccaccggccatctcccccatcatcaagaacgccatctccctgccccagctcaaccaggccgcctacgacagcctcgtggttggcaagctcagcttcgacagcagccccaccagctccacggacggccactccagctacggcctggactctgggttctgcaccatctcccgcctgccccgctcggaaaagccgcatgaccgagaccgggatggttccttcccctctgagcccgggcttcgccgctctgactctctcttgtccttccgcctggacctcgaccttgggccctcactcctcagcgagctgctaggggtcatgagcctgtcgggctagtcggggccccgactagcccgacagcgtgaccatctcctggacccgccagaatggcgaagctgtgaaaacccacaccaacatctccgagagccaccccaatgccactttcagcgaccactagggtgacgaccagcatccgcgaggatgactggaattccgggaagagtttcacacgcaccgtgacccacacagacccgccctccacactgaagcagaccatctcccggccacaagggcgagatcctgcacagccccgatgtctactcgcagccaccaacccgggaacagcatgaacctgtcgggctagtcggg

SEQ ID NO: 300924 - DNA, 2108 bp, Homo sapiens
accggcccagcgactctcccgggctgccagccgggacgcgcggccgccgccgctgcagacgacgagtccgccctcgtcccgcgcccccggggctcgcggagccaggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggatgtcttcggggacacgtccttcctcagcaaccacggtggcagctccgggagcacccatcgctcaccccgcagcttcctggccaagaagctgcagctggtgcggagggtgggggcgcccccccggaggatggcatctccccctgcaccctccccggctccaccggccatctcccccatcatcaagaacgccatctccctgccccagctcaaccaggccgcctacgacagcctcgtggttggcaagctcagcttcgacagcagccccaccagctccacggacggccactccagctacggcctggactctgggttctgcaccatctcccgcctgccccgctcggaaaagccgcatgaccgagaccgggatggttccttcccctctgagcccgggcttcgccgctctgactctctcttgtccttccgcctggacctcgaccttgggccctcactcctcagcgagctgctaggggtcatgagcctgccagaagcccctgcagctgagactccagcccccgctgcaaaccccccagcccctactgcaaaccccacgggtcctgctgcaaaccccccagccactactgcaaaccccccagcgcctgctgcaaacccctcagcacctgccgcaacccccacgggtcctgctgcaaatcccccagcccctgccgcaagctccacaccccatggacactgtcccaatggggtaacagctgggttgggcccagtggctgaggtgaagtccagcccagtgggagggggtccccgaggacctgctggccctgccctcggcaggcactggggagcaggctgggatggcggccaccactacccagagatggatgcgcggcaggagcgggtggaggtgctgccccaagcccgggcctcctgggagagcctggacgaagagtggagggcgccccaggcaggcagcaggaccccagtgcccagcacagtgcaagcaaacacctttgaatttgcggatgctgaggaggatgatgaggtcaaggtgtgaggggctggggcacggtcccagggccccacctaggtgcagagccggcccctcacctaacagctggttcctaccagaccggagaggggagaagtcatgttgcccctaaacccctccccacctctgcaggacagacatgggagggaggacagggaaggccaggcttgctctgggacttttatgctcccagaggccctgccaaactgaccacctcccccgactgccactctggacctaatagctgttccttaggccccactccatgccacccccaccagctggaggacccagcctcacagtgtgtcctttgtgccagaccaagcggcccgtggggggtggggggcagggagtgtaccacacagggccattgtctcacctcccaaagggaccgcctgcccccagctcatcccagagcgtccctgctgcaaccctgacagccgtctcccaggccgcttccccaacatccccgccccagcctccctcttaccccagaaaggtcaggtatgacctcccggggaggaatcccacctgcctgtataccccagacttgcctctggggcctgattaaataaggctgttttgataaaa

SEQ ID NO: 300925 - DNA, 2123 bp, Homo sapiens
accggcccagcgactctcccgggctgccagccgggacgcgcggccgccgccgctgcagacgacgagtccgccctcgtcccgcgcccccggggctcgcggagccaggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccatgcatgtgggccgtggcggggatgtcttcggggacacgtccttcctcagcaaccacggtggcagctccgggagcacccatcgctcaccccgcagcttcctggccaagaagctgcagctggtgcggagggtgggggcgcccccccggaggatggcatctccccctgcaccctccccggctccaccggccatctcccccatcatcaagaacgccatctccctgccccagctcaaccaggccgcctacgacagcctcgtggttggcaagctcagcttcgacagcagccccaccagctccacggacggccactccagctacggcctggactctgggttctgcaccatctcccgcctgccccgctcggaaaagccgcatgaccgagaccgggatggttccttcccctctgagcccgggcttcgccgctctgactctctcttgtccttccgcctggacctcgaccttgggccctcactcctcagcgagctgctaggggtcatgagcctgccagaagcccctgcagctgagactccagcccccgctgcaaaccccccagcccctactgcaaaccccacgggtcctgctgcaaaccccccagccactactgcaaaccccccagcgcctgctgcaaacccctcagcacctgccgcaacccccacgggtcctgctgcaaatcccccagcccctgccgcaagctccacaccccatggacactgtcccaatggggtaacagctgggttgggcccagtggctgaggtgaagtccagcccagtgggagggggtccccgaggacctgctggccctgccctcggcaggcactggggagcaggctgggatggcggccaccactacccagagatggatgcgcggcaggagcgggtggaggtgctgccccaagcccgggcctcctgggagagcctggacgaagagtggagggcgccccaggcaggcagcaggaccccagtgcccagcacagtgcaagcaaacacctttgaatttgcggatgctgaggaggatgatgaggtcaaggtgtgaggggctggggcacggtcccagggccccacctaggtgcagagccggcccctcacctaacagctggttcctaccagaccggagaggggagaagtcatgttgcccctaaacccctccccacctctgcaggacagacatgggagggaggacagggaaggccaggcttgctctgggacttttatgctcccagaggccctgccaaactgaccacctcccccgactgccactctggacctaatagctgttccttaggccccactccatgccacccccaccagctggaggacccagcctcacagtgtgtcctttgtgccagaccaagcggcccgtggggggtggggggcagggagtgtaccacacagggccattgtctcacctcccaaagggaccgcctgcccccagctcatcccagagcgtccctgctgcaaccctgacagccgtctcccaggccgcttccccaacatccccgccccagcctccctcttacctcccggggaggaatcccacctgcctgtataccccagacttgcctctggggcctgattaaataaggctgttttgataaaa

SEQ ID NO: 300926 - DNA, 1036 bp, Homo sapiens
accggcccagcgactctcccgggctgccagccgggacgcgcggccgccgccgctgcagacgacgagtccgccctcgtcccgcgcccccggggctcgcggagccaggtctccacctctgggcaggagagttgccgaccacctcgggggtgctttctctgcgcttgaacatctatagctgcttctgaggggctgggagccgggcccctgggagagacgagccatgaaccccccacagcctctgcatttggggacctcaccttaggagagtgccatttacagcttccgccagggcaaaggagctgagcagccatcccaagcccagcccacctccctcccccggcccctggtaggcatggactagcagctgtgagcagccagagctgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccatgcatgtgggccgtggcggggatgtcttcggggacacgtccttcctcagcaaccacggtggcagctccgggagcacccatcgctcaccccgcagcttcctggccaagaagctgcagctggtgcggagggtgggggcgcccccccggaggatggcatctccccctgcaccctccccggctccaccggccatctcccccatcatcaagaacgccatctccctgccccagctcaaccaggccgcctacgacagcctcgtggttggcaagctcagcttcgacagcagccccaccagctccacggacggccactccagctacggcctggactctgggttctgcaccatctcccgcctgccccgctcggaaaagccgcatgaccgagaccgggatggttccttcccctctgagcccgggcttcgccgctctgactctctcttgcttcttcgcactcatcctaatcctactcctaatcacataagctattcccccgaggggtaaggggctcccgg

SEQ ID NO: 300927 - DNA, 1478 bp, Homo sapiens
acaggaagatcacacaggtgaccatggagtgtattctattggaaagatgggagaaaccgaggccagagaggggagggactagccagaggccacacagcaagccaggactggtcctgtctcccctcctgaattcctggtgagggaccccagctctgagcccactgcccatttctcttctaggcctggactctgggttctgcaccatctcccgcctgccccgctcggaaaagccgcatgaccgagaccgggatggttccttcccctctgagcccgggcttcgccgctctgactctctcttgtccttccgcctggacctcgaccttgggccctcactcctcagcgagctgctaggggtcatgagcctgccagaagcccctgcagctgagactccagcccccgctgcaaaccccccagcccctactgcaaaccccacgggtcctgctgcaaaccccccagccactactgcaaaccccccagcgcctgctgcaaacccctcagcacctgccgcaacccccacgggtcctgctgcaaatcccccagcccctgccgcaagctccacaccccatggacactgtcccaatggggtaacagctgggttgggcccagtggctgaggtgaagtccagcccagtgggagggggtccccgaggacctgctggccctgccctcggcaggcactggggagcaggctgggatggcggccaccactacccagagatggatgcgcggcaggagcgggtggaggtgctgccccaagcccgggcctcctgggagagcctggacgaagagtggagggcgccccaggcaggcagcaggaccccagtgcccagcacagtgcaagcaaacacctttgaatttgcggatgctgaggaggatgatgaggtcaaggtgtgaggggctggggcacggtcccagggccccacctaggtgcagagccggcccctcacctaacagctggttcctaccagaccggagaggggagaagtcatgttgcccctaaacccctccccacctctgcaggacagacatgggagggaggacagggaaggccaggcttgctctgggacttttatgctcccagaggccctgccaaactgaccacctcccccgactgccactctggacctaatagctgttccttaggccccactccatgccacccccaccagctggaggacccagcctcacagtgtgtcctttgtgccagaccaagcggcccgtggggggtggggggcagggagtgtaccacacagggccattgtctcacctcccaaagggaccgcctgcccccagctcatcccagagcgtccctgctgcaaccctgacagccgtctcccaggccgcttccccaacatccccgccccagcctccctcttaccccagaaaggtcaggtatgacctcccggggaggaatcccacctgcctgtataccccagacttgcctctggggcctgattaaataaggctgttttgataaaa

SEQ ID NO: 300928 - DNA, 2635 bp, Homo sapiens
attgcagcattctttggattttgagaaaagttccacagaaggcagtgaaagctccataatggggaattccattgacacagtcagatatggcaaagaatcagatttaggggatgttagtgaagaacatggtgaaaataaggaaagctcaaataacgagcaggacaatagtctgcttgaacagtatttaacttcagttcaacagctggaagatgctgatgagaggaccaattttgatacagagacaagagatagcaaacttcacattgcttgtttcccagtacagttagatacattgtctgacggtgcttctgtagatgagagtcatggcatatctcctcctttgcaaggtgaaattagccagacacaagagaattctaaattaaatgcagaagttcaagggcagcagccagaatgtgattctacatttcagctattgcatgttggtgttactgtgtagcatgtcttttgggaggcagatatccacttaacttttcttaaaaatactttcagttgcctttgcttttttttggagggaaatactccctacccctaattttgttactacttatatagaatttgtattcatgtcttatatttttcagattctagatattgagctgagttttcattttgattttgttagctttttacttagctgtaaggtaccaaactatttatattgaaagctatatgcactttatttcttaactgaattgcatcaacaatgttcctgtttctttcatgtactcatttactttcaaaaataagctagaatatattaaagaaaatagaaaaaattaccttaaatatataaataagagaattttggcccttctgtgtctgagaaaattaattatatagcaaggaatgaaatttgataaagcaaatataaatgagaaatatgaggattgtgaattattgaaatttgccagtctccctggtgtaaaatgtttttttaaagccttttttcctcctttcggagtcaaggaaagcctttctataagcaaattaaggaagaaaaggtaggattataagatttctcaatggggatgattaaattgtctcatggaaaacttcagttaatgtcatgcatcagttttaacatatgaagtaaagtgttctatccaggattaaagtcaagtttacttaggcaacacaagaatatttcacttagatatgaagaaaggaaacactagtctccattcacttgaaatactctcatggcaaatatttatcctctcattaagtgctttttcaccctataggtaagcatttttgtgccaacatgttgtcagaaattaatgtatgttcatctcctctgttcctgcttatttttacttatatatttcagcagaaggtccgtggccattcacttcaattttgacctctgtcccatagtgaagaacatttaaagtaatactactggtcgaatatgaatgactttttaggaactactttttgtctaacctgaaaaagttccacatttggaagacaatttaatgatggtgaagaaataataaacctcactttacttgttaaaagggatatatatatatatatatatgtctgcaacttcagggagaaataagattgtgtttgaatattgtaggtagatgcatttgtaattaaggataatatcgtttaacaacatgtatttggtttccctcaacttacagacatacagctatttaaaactatggcaatacttaagcatctctaaatttaggtgctaaatatctattattctgttgtagtcattaggtgcccttctctgaagttatgtaaaataaaagcatctgatccttcaaggataaagttgaggatcacatggtacgtggcatttgttgttattgttttttaaagagatggaggctggctctgttggtgcggtgccatgatcatagttcactataacctcgaactcctggctcaagtgatctcccacttcagcctcccgagtatctgggattataagcaagagccactgctcccagctcatggtatttgttgatagtcataacatttttcctgtatggtaagacgtatttttctcagtttataaatacgtagcactcaggttgagacgacttggattttattcttagaaatccagaatcccttgaaaaggaaatattttctgtttcttataaataaaagagtaatcttactttcagaaggattttccttagtgaaacatgtgtaacattgaatgcatgttaaataaaaatggaatttctaactttttttcaatagtgctaattatcttttctgaatgattttgaatgtcttcttaaatataccctatttttctattttaaagttaagtgcctcacttgctgtccatagttagacaaagaaaaaccaatttccactgcactagtaccaaaatactactttatacattagtttttcataaaagctgctggaatgtcatgattcagtattacctaaatagatttctgctaaaatcctctccctcctgtcttttttaagttatggaaaaacacaactaaattcatttgatcatcagcacttgttagcaggatttccttttttacctttgccttgtttctttagcccacaaatagtactcagcatactttcattaaaaatttggcacaatatgataattgtt

SEQ ID NO: 300929 - DNA, 5468 bp, Homo sapiens
attgcagcattctttggattttgagaaaagttccacagaaggcagtgaaagctccataatggggaattccattgacacagtcagatatggcaaagaatcagatttaggggatgttagtgaagaacatggtgaaaataaggaaagctcaaataacgagcaggacaatagtctgcttgaacagtatttaacttcagttcaacagctggaagatgctgatgagaggaccaattttgatacagagacaagagatagcaaacttcacattgcttgtttcccagtacagttagatacattgtctgacggtgcttctgtagatgagagtcatggcatatctcctcctttgcaaggtgaaattagccagacacaagagaattctaaattaaatgcagaagttcaagggcagcagccagaatgtgattctacatttcagctattgcatgttggtgttactgtgtagcatgtcttttgggaggcagatatccacttaacttttcttaaaaatactttcagttgcctttgcttttttttggagggaaatactccctacccctaattttgttactacttatatagaatttgtattcatgtcttatatttttcagattctagatattgagctgagttttcattttgattttgttagctttttacttagctgtaaggtaccaaactatttatattgaaagctatatgcactttatttcttaactgaattgcatcaacaatgttcctgtttctttcatgtactcatttactttcaaaaataagctagaatatattaaagaaaatagaaaaaattaccttaaatatataaataagagaattttggcccttctgtgtctgagaaaattaattatatagcaaggaatgaaatttgataaagcaaatataaatgagaaatatgaggattgtgaattattgaaatttgccagtctccctggtgtaaaatgtttttttaaagccttttttcctcctttcggagtcaaggaaagcctttctataagcaaattaaggaagaaaaggtaggattataagatttctcaatggggatgattaaattgtctcatggaaaacttcagttaatgtcatgcatcagttttaacatatgaagtaaagtgttctatccaggattaaagtcaagtttacttaggcaacacaagaatatttcacttagatatgaagaaaggaaacactagtctccattcacttgaaatactctcatggcaaatatttatcctctcattaagtgctttttcaccctataggtaagcatttttgtgccaacatgttgtcagaaattaatgtatgttcatctcctctgttcctgcttatttttacttatatatttcagcagaaggtccgtggccattcacttcaattttgacctctgtcccatagtgaagaacatttaaagtaatactactggtcgaatatgaatgactttttaggaactactttttgtctaacctgaaaaagttccacatttggaagacaatttaatgatggtgaagaaataataaacctcactttacttgttaaaagggatatatatatatatatatatgtctgcaacttcagggagaaataagattgtgtttgaatattgtaggtagatgcatttgtaattaaggataatatcgtttaacaacatgtatttggtttccctcaacttacagacatacagctatttaaaactatggcaatacttaagcatctctaaatttaggtgctaaatatctattattctgttgtagtcattaggtgcccttctctgaagttatgtaaaataaaagcatctgatccttcaaggataaagttgaggatcacatggtacgtggcatttgttgttattgttttttaaagagatggaggctggctctgttggtgcggtgccatgatcatagttcactataacctcgaactcctggctcaagtgatctcccacttcagcctcccgagtatctgggattataagcaagagccactgctcccagctcatggtatttgttgatagtcataacatttttcctgtatggtaagacgtatttttctcagtttataaatacgtagcactcaggttgagacgacttggattttattcttagaaatccagaatcccttgaaaaggaaatattttctgtttcttataaataaaagagtaatcttactttcagaaggattttccttagtgaaacatgtgtaacattgaatgcatgttaaataaaaatggaatttctaactttttttcaatagtgctaattatcttttctgaatgattttgaatgtcttcttaaatataccctatttttctattttaaagttaagtgcctcacttgctgtccatagttagacaaagaaaaaccaatttccactgcactagtaccaaaatactactttatacattagtttttcataaaagctgctggaatgtcatgattcagtattacctaaatagatttctgctaaaatcctctccctcctgtcttttttaagttatggaaaaacacaactaaattcatttgatcatcagcacttgttagcaggatttccttttttacctttgccttgtttctttagcccacaaatagtactcagcatactttcattaaaaatttggcacaatatgataattgttaatattctgttcttcgtctgtgttttatttaacttttactagtgtttagaagtgcaagaatattaaatagccccttccttaactgtacatattatcttgaatgtagataaaatgaaaatactgtaaattagagtgtaggaaaactggcatagagttaatatattttaatgggtttacattatactttaaaagtaatttatataattaaaatatttggttttaactctatgggctattctttggttggctgaagagggaatgggtctagtaaggtttggaaagttaagctttgaacatggtctttgtgtttttttcctaacaaggaaaggtttagttcagctgtgctattttagtacacatcagttctcttgatttatggaagattcagtttatcaattaagaattcctgcagaagcacagaatcataccatgtaagagttggaaggaagcttaagagatttctgttcgaatctctttgtttcaaagatgaaactaaagcacagcatgttaaatgacttgtctaagttatagctagttagtagtaaataaactgaaaacctatatgctactgtagtccaaaattttattatgtcctcttaatctttacatttagtgagtcagtaaggaaatctctgcatatttctcattctctttgaaagaggaaaaaaacttctaagagagctacaactctatcactcatgacagagttgcttgtagaaaataactaattccttcagaaccctgagtgaattttttctaagaaatgtgacttgattaaaatggtttcaaaagagcaatagtggaaattaaagttttagaaaagagacctggcgtggtggttgacaactgtaatcccagtgctttgggaggctgaggccagaggatcacttgaggccaggagttcaagaccagcctggacaacatagcaagacccccctctctacaaaaaaaaattttttctgaaaagaataagtacattttagagtccatttatttgacgacaggcagtatgacaggttgctgaggtatataaaattttctagagaaatgctgagtttgatgacattttatcttcagttttgtagaacagatgttaaaatgttaactctcctggtgtgcagaaagctgtaatcatgacagttgataatatgcaatttagtttgattttataggtttaattataaaaggcttcacaatatgcatgttttaggaaaatgttcatttatttagtcatataatcgtttgtatatatgtaaataactttattctggaataatgtgggtgccatcttgagcgtgtgtttttatctgttttggattattttttgtatacaaacaccataatactgtattttcctgttatctacttaagtctagttctactttttcccaataatttcaggaaaatacaagcttgagatattatactatctcccttggtattttttgtgtgcaaagtcttagaattggatttataacattgataataaaaatataaaacgtttttcctcgggagttaagatggtaaaaagaaaaaaatagaatgaatatgatcatttctccatcataaaggaaagaagagacttcattgtgtgtgtgttttttttttttttttcgagatagagtttcactgttgtcacccaggctggtctcagctcactgcaacctccacttcctgggtacaagcgattctcctgcctcagcttcctgtgtagctgggattacaggtgtgcaaccacaaggctcggctaatttttttgtatttttagtagagatggggtttcaccatgttggccaggctggtctcgaactcctgacctcaagtgatccacccacctcggcctcgcaaagtgctgagattacaggtgtgagccactgtgcccagccgagacttcattgtttaatgtatatttttattttttccaaacaccagctcgaatcagagtatatttttattttgccacatacctttaaaaggtatttattgtgtcataatgttttaaatgttaaatatatgataccctcattcatgaagtgaagcagaaagggtctgtaaggaacattctaaacatttttaatgatattgcttttactgatcaagcttgttgtgccatattaaaattaaaagtcaaataaacaaagcagtcctcacagccttggaaagaaatagataattgtcttcttaagatgaggtgctttttatctgtggatgaatggaaatcacactgaattttaattcttatttattttagtggatagcaggaatcactctgtagtagttgtgttcattttcttttctttttcttttcttttttttgagagagtctcgctctgtcaccaggctggagtgcagtggcgtgatctcggctcactgcaacctccatctcctgggttcaagtgattctcctgcctcatcctcccgagtagctaagactacaggcacacgccaccatgcccagctaatttttatatttttagtagagatggggtttcaccatgttggccaggatggtctcaatctcttgacctcgtgatccacccagtttggcctcccaaagtgctgggattacaggcgtgagccactacacctggccttgttcatcttctaattaaatatctttgaatgttttgtaataattttaatgttgacaataagagtttaaaaataatttgattttggactgtatttagatttctctttaattttgctgtagaaatagtaaatgatttaaagtggttatgatgtgttttatgaaggcttactattttatattgtacttatttaatttgtatttgagtctgtctaattttaaataaaaggtttatacatttga

SEQ ID NO: 300930 - DNA, 5467 bp, Homo sapiens
  misc_feature (4889)..(4889): n is a, c, g, or t
  misc_feature (4892)..(4892): n is a, c, g, or t
  misc_feature (4909)..(4909): n is a, c, g, or t
  misc_feature (4918)..(4918): n is a, c, g, or t
  misc_feature (4939)..(4939): n is a, c, g, or t
attgcagcattctttggattttgagaaaagttccacagaaggcagtgaaagctccataatggggaattccattgacacagtcagatatggcaaagaatcagatttaggggatgttagtgaagaacatggtgaaaataaggaaagctcaaataacgagcaggacaatagtctgcttgaacagtatttaacttcagttcaacagctggaagatgctgatgagaggaccaattttgatacagagacaagagatagcaaacttcacattgcttgtttcccagtacagttagatacattgtctgacggtgcttctgtagatgagagtcatggcatatctcctcctttgcaaggtgaaattagccagacacaagagaattctaaattaaatgcagaagttcaagggcagcagccagaatgtgattctacatttcagctattgcatgttggtgttactgtgtagcatgtcttttgggaggcagatatccacttaacttttcttaaaaatactttcagttgcctttgcttttttttggagggaaatactccctacccctaattttgttactacttatatagaatttgtattcatgtcttatatttttcagattctagatattgagctgagttttcattttgattttgttagctttttacttagctgtaaggtaccaaactatttatattgaaagctatatgcactttatttcttaactgaattgcatcaacaatgttcctgtttctttcatgtactcatttactttcaaaaataagctagaatatattaaagaaaatagaaaaaattaccttaaatatataaataagagaattttggcccttctgtgtctgagaaaattaattatatagcaaggaatgaaatttgataaagcaaatataaatgagaaatatgaggattgtgaattattgaaatttgccagtctccctggtgtaaaatgtttttttaaagccttttttcctcctttcggagtcaaggaaagcctttctataagcaaattaaggaagaaaaggtaggattataagatttctcaatggggatgattaaattgtctcatggaaaacttcagttaatgtcatgcatcagttttaacatatgaagtaaagtgttctatccaggattaaagtcaagtttacttaggcaacacaagaatatttcacttagatatgaagaaaggaaacactagtctccattcacttgaaatactctcatggcaaatatttatcctctcattaagtgctttttcaccctataggtaagcatttttgtgccaacatgttgtcagaaattaatgtatgttcatctcctctgttcctgcttatttttacttatatatttcagcagaaggtccgtggccattcacttcaattttgacctctgtcccatagtgaagaacatttaaagtaatactactggtcgaatatgaatgactttttaggaactactttttgtctaacctgaaaaagttccacatttggaagacaatttaatgatggtgaagaaataataaacctcactttacttgttaaaagggatatatatatatatatatatgtctgcaacttcagggagaaataagattgtgtttgaatattgtaggtagatgcatttgtaattaaggataatatcgtttaacaacatgtatttggtttccctcaacttacagacatacagctatttaaaactatggcaatacttaagcatctctaaatttaggtgctaaatatctattattctgttgtagtcattaggtgcccttctctgaagttatgtaaaataaaagcatctgatccttcaaggataaagttgaggatcacatggtacgtggcatttgttgttattgttttttaaagagatggaggctggctctgttggtgcggtgccatgatcatagttcactataacctcgaactcctggctcaagtgatctcccacttcagcctcccgagtatctgggattataagcaagagccactgctcccagctcatggtatttgttgatagtcataacatttttcctgtatggtaagacgtatttttctcagtttataaatacgtagcactcaggttgagacgacttggattttattcttagaaatccagaatcccttgaaaaggaaatattttctgtttcttataaataaaagagtaatcttactttcagaaggattttccttagtgaaacatgtgtaacattgaatgcatgttaaataaaaatggaatttctaactttttttcaatagtgctaattatcttttctgaatgattttgaatgtcttcttaaatataccctatttttctattttaaagttaagtgcctcacttgctgtccatagttagacaaagaaaaaccaatttccactgcactagtaccaaaatactactttatacattagtttttcataaaagctgctggaatgtcatgattcagtattacctaaatagatttctgctaaaatcctctccctcctgtcttttttaagttatggaaaaacacaactaaattcatttgatcatcagcacttgttagcaggatttccttttttacctttgccttgtttctttagcccacaaatagtactcagcatactttcattaaaaatttggcacaatatgataattgttaatattctgttcttcgtctgtgttttatttaacttttactagtgtttagaagtgcaagaatattaaatagccccttccttaactgtacatattatcttgaatgtagataaaatgaaaatactgtaaattagagtgtaggaaaactggcatagagttaatatattttaatgggtttacattatactttaaaagtaatttatataattaaaatatttggttttaactctatgggctattctttggttggctgaagagggaatgggtctagtaaggtttggaaagttaagctttgaacatggtctttgtgtttttttcctaacaaggaaaggtttagttcagctgtgctattttagtacacatcagttctcttgatttatggaagattcagtttatcaattaagaattcctgcagaagcacagaatcataccatgtaagagttggaaggaagcttaagagatttctgttcgaatctctttgtttcaaagatgaaactaaagcacagcatgttaaatgacttgtctaagttatagctagttagtagtaaataaactgaaaacctatatgctactgtagtccaaaattttattatgtcctcttaatctttacatttagtgagtcagtaaggaaatctctgcatatttctcattctctttgaaagaggaaaaaaacttctaagagagctacaactctatcactcatgacagagttgcttgtagaaaataactaattccttcagaaccctgagtgaattttttctaagaaatgtgacttgattaaaatggtttcaaaagagcaatagtggaaattaaagttttagaaaagagacctggcgtggtggttgacaactgtaatcccagtgctttgggaggctgaggccagaggatcacttgaggccaggagttcaagaccagcctggacaacatagcaagacccccctctctacaaaaaaaaattttttctgaaaagaataagtacattttagagtccatttatttgacgacaggcagtatgacaggttgctgaggtatataaaattttctagagaaatgctgagtttgatgacattttatcttcagttttgtagaacagatgttaaaatgttaactctcctggtgtgcagaaagctgtaatcatgacagttgataatatgcaatttagtttgattttataggtttaattataaaaggcttcacaatatgcatgttttaggaaaatgttcatttatttagtcatataatcgtttgtatatatgtaaataactttattctggaataatgtgggtgccatcttgagcgtgtgtttttatctgttttggattattttttgtatacaaacaccataatactgtattttcctgttatctacttaagtctagttctactttttcccaataatttcaggaaaatacaagcttgagatattatactatctcccttggtattttttgtgtgcaaagtcttagaattggatttataacattgataataaaaatataaaacgtttttcctcgggagttaagatggtaaaaagaaaaaaatagaatgaatatgatcatttctccatcataaaggaaagaagagacttcattgtgtgtgtgttttttttttttttttcgagatagagtttcactgttgtcacccaggctggtctcagctcactgcaacctccacttcctgggtacaagcgattctcctgcctcagcttcctgtgtagctgggattacaggtgtgcaaccacaaggctcggctaatttttttgtatttttagtagagatggggtttcaccatgttggccaggctggtctcgaactcctgacctcaagtgatccacccacctcggcctcgcaaagtgctgagattacaggtgtgagccactgtgcccagccgagacttcattgtttaatgtatatttttattttttccaaacaccagctcgaatcagagtatatttttattttgccacatacctttaaaaggtatttattgtgtcataatgttttaaatgttaaatatatgataccctcattcatgaagtgaagcagaaagggtctgtaaggaacattctaaacatttttaatgatattgcttttactgatcaagcttgttgtgccatattaaaattaaaagtcaaataaacaaagcagtcctcacagccttggaaagaaatagataattgtcttcttaagatgaggtgctttttatctgtggatgaatggaaatcacaccgcacaccccaacccccacccacccccancgnacagcagcaacaccccncagcagccncgcccacccccccctcccctnccctccccgagcagacccccgcccccccaccagcggctggagtgcagtggcgtgatctcggctcactgcaacctccatctcctgggttcaagtgattctcctgcctcatcctcccgagtagctaagactacaggcacacgccaccatgcccagctaatttttatatttttagtagagatggggtttcaccatgttggccaggatggtctcaatctcttgacctcgtgatccacccagtttggcctcccaaagtgctgggattacaggcgtgagccactacacctggccttgttcatcttctaattaaatatctttgaatgttttgtaataattttaatgttgacaataagagtttaaaaataatttgattttggactgtatttagatttctctttaattttgctgtagaaatagtaaatgatttaaagtggttatgatgtgttttatgaaggcttactattttatattgtacttatttaatttgtatttgagtctgtctaattttaaataaaaggtttatacatttga

SEQ ID NO: 300931 - DNA, 4377 bp, Homo sapiens
attgcagcattctttggattttgagaaaagttccacagaaggcagtgaaagctccataatggggaattccattgacacagtcagatatggcaaagaatcagatttaggggatgttagtgaagaacatggtgaaaataaggaaagctcaaataacgagcaggacaatagtctgcttgaacagtatttaacttcagttcaacagctggaagatgctgatgagaggaccaattttgatacagagacaagagatagcaaacttcacattgcttgtttcccagtacagttagatacattgtctgacggtgcttctgtagatgagagtcatggcatatctcctcctttgcaaggtgaaattagccagacacaagagaattctaaattaaatgcagaagttcaagggcagcagccagaatgtgattctacatttcagctattgcatgttggtgttactgtgtagcatgtcttttgggaggcagatatccacttaacttttcttaaaaatactttcagttgcctttgcttttttttggagggaaatactccctacccctaattttgttactacttatatagaatttgtattcatgtcttatatttttcagattctagatattgagctgagttttcattttgattttgttagctttttacttagctgtaaggtaccaaactatttatattgaaagctatatgcactttatttcttaactgaattgcatcaacaatgttcctgtttctttcatgtactcatttactttcaaaaataagctagaatatattaaagaaaatagaaaaaattaccttaaatatataaataagagaattttggcccttctgtgtctgagaaaattaattatatagcaaggaatgaaatttgataaagcaaatataaatgagaaatatgaggattgtgaattattgaaatttgccagtctccctggtgtaaaatgtttttttaaagccttttttcctcctttcggagtcaaggaaagcctttctataagcaaattaaggaagaaaaggtaggattataagatttctcaatggggatgattaaattgtctcatggaaaacttcagttaatgtcatgcatcagttttaacatatgaagtaaagtgttctatccaggattaaagtcaagtttacttaggcaacacaagaatatttcacttagatatgaagaaaggaaacactagtctccattcacttgaaatactctcatggcaaatatttatcctctcattaagtgctttttcaccctataggtaagcatttttgtgccaacatgttgtcagaaattaatgtatgttcatctcctctgttcctgcttatttttacttatatatttcagcagaaggtccgtggccattcacttcaattttgacctctgtcccatagtgaagaacatttaaagtaatactactggtcgaatatgaatgactttttaggaactactttttgtctaacctgaaaaagttccacatttggaagacaatttaatgatggtgaagaaataataaacctcactttacttgttaaaagggatatatatatatatatatatgtctgcaacttcagggagaaataagattgtgtttgaatattgtaggtagatgcatttgtaattaaggataatatcgtttaacaacatgtatttggtttccctcaacttacagacatacagctatttaaaactatggcaatacttaagcatctctaaatttaggtgctaaatatctattattctgttgtagtcattaggtgcccttctctgaagttatgtaaaataaaagcatctgatccttcaaggataaagttgaggatcacatggtacgtggcatttgttgttattgttttttaaagagatggaggctggctctgttggtgcggtgccatgatcatagttcactataacctcgaactcctggctcaagtgatctcccacttcagcctcccgagtatctgggattataagcaagagccactgctcccagctcatggtatttgttgatagtcataacatttttcctgtatggtaagacgtatttttctcagtttataaatacgtagcactcaggttgagacgacttggattttattcttagaaatccagaatcccttgaaaaggaaatattttctgtttcttataaataaaagagtaatcttactttcagaaggattttccttagtgaaacatgtgtaacattgaatgcatgttaaataaaaatggaatttctaactttttttcaatagtgctaattatcttttctgaatgattttgaatgtcttcttaaatataccctatttttctattttaaagttaagtgcctcacttgctgtccatagttagacaaagaaaaaccaatttccactgcactagtaccaaaatactactttatacattagtttttcataaaagctgctggaatgtcatgattcagtattacctaaatagatttctgctaaaatcctctccctcctgtcttttttaagttatggaaaaacacaactaaattcatttgatcatcagcacttgttagcaggatttccttttttacctttgccttgtttctttagcccacaaatagtactcagcatactttcattaaaaatttggcacaatatgataattgttaatattctgttcttcgtctgtgttttatttaacttttactagtgtttagaagtgcaagaatattaaatagccccttccttaactgtacatattatcttgaatgtagataaaatgaaaatactgtaaattagagtgtaggaaaactggcatagagttaatatattttaatgggtttacattatactttaaaagtaatttatataattaaaatatttggttttaactctatgggctattctttggttggctgaagagggaatgggtctagtaaggtttggaaagttaagctttgaacatggtctttgtgtttttttcctaacaaggaaaggtttagttcagctgtgctattttagtacacatcagttctcttgatttatggaagattcagtttatcaattaagaattcctgcagaagcacagaatcataccatgtaagagttggaaggaagcttaagagatttctgttcgaatctctttgtttcaaagatgaaactaaagcacagcatgttaaatgacttgtctaagttatagctagttagtagtaaataaactgaaaacctatatgctactgtagtccaaaattttattatgtcctcttaatctttacatttagtgagtcagtaaggaaatctctgcatatttctcattctctttgaaagaggaaaaaaacttctaagagagctacaactctatcactcatgacagagttgcttgtagaaaataactaattccttcagaaccctgagtgaattttttctaagaaatgtgacttgattaaaatggtttcaaaagagcaatagtggaaattaaagttttagaaaagagacctggcgtggtggttgacaactgtaatcccagtgctttgggaggctgaggccagaggatcacttgaggccaggagttcaagaccagcctggacaacatagcaagacccccctctctacaaaaaaaaattttttctgaaaagaataagtacattttagagtccatttatttgacgacaggcagtatgacaggttgctgaggtatataaaattttctagagaaatgctgagtttgatgacattttatcttcagttttgtagaacagatgttaaaatgttaactctcctggtgtgcagaaagctgtaatcatgacagttgataatatgcaatttagtttgattttataggtttaattataaaaggcttcacaatatgcatgttttaggaaaatgttcatttatttagtcatataatcgtttgtatatatgtaaataactttattctggaataatgtgggtgccatcttgagcgtgtgtttttatctgttttggattattttttgtatacaaacaccataatactgtattttcctgttatctacttaagtctagttctactttttcccaataatttcaggaaaatacaagcttgagatattatactatctcccttggtattttttgtgtgcaaagtcttagaattggatttataacattgataataaaaatataaaacgtttttcctcgggagttaagatggtaaaaagaaaaaaatagaatgaatatgatcatttctccatcataaaggaaagaagagacttcattgtgtgtgtgttttttttttttttttcgagatagagtcaagaccttttcgaaaaaaatattaaaagccaggcgtggtggctcacactgataatcccagtactttgggaagccaaggcgggtggatcatggtgaaaccctgtctctactggaaaa

SEQ ID NO: 300932 - DNA, 1887 bp, Homo sapiens
acttggtcttagttcccagtcgcggccaaatcacgcctcagccacctcccgcaagcctctcactgcctcagccacgctttccaggctggtttctggtccccatccgcggctggtccggccctgggaccgaatcacttcccagcgagaggaaggtcaaatttctcgaccggctacgggaaggtcgcggccgccgccctgtcagccgcctcggcgcccccaggacccctcgggtctctttaaccggaagcggaagtgcgtgtcggcgggatcatggcgactttggtcgaactgccggactcggtcctgctcgagatcttctcttacctcccggtacgggaccggatccgcatctccagggtctgtcaccgctggaagaggctggtggacgaccggtggctgtggcgacatgtcgacctgacgctctacacgatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaatgccggccctggagagtctgtgcctgcagggtcccctcgtcaccccagaaatgccctcccccactgaaatcctctcctcctgcctcactatgcccaagctcagagtccttgagctgcaggggctggggtgggagggtcaggaggcggagaagatcctgtgtaaggggctgccccactgtatggtcatcgtcagggcttgccccaaagagtctatggactggtggatgtaactactccacctgcccttgggacccatcccagttttcatcattgagccccagaccctctgagcagcaccttgaagagggcagataatcagacttgaggaaactgaaagccccaggttgagagaacagaggcctagggacctccagaccattggaatcactgtttgccagctgtgtggccttggtcatatcatcagcctctgggaagcctagttcccacatctggaaataaggatgatcatagctacctcacggttacattgcaaagccttactctaaaagctcccagcctccagaggctctcaatgaagagtcaccttcatggtcgtcttcaggaacaggacggatgaagaaggggtggggttaagactcaggggcacctgagggtctgagcccccttatgagtacccaagaaggactgtctatgcatgcacacccacaagcctatacaccatttatatacctacacgcacgcaagagacgcggagagataggcgatgcagactcgcgattcaatgatcgatatgctcataaaagtgctcaattatattttctgtattttgtatgctgtattttccaagacgtatattattttactattaaagaaaaaaatcatttttttttcccgaaaaaaaaaaa

SEQ ID NO: 300933 - DNA, 1931 bp, Homo sapiens
acttggtcttagttcccagtcgcggccaaatcacgcctcagccacctcccgcaagcctctcactgcctcagccacgctttccaggctggtttctggtccccatccgcggctggtccggccctgggaccgaatcacttcccagcgagaggaaggtcaaatttctcgaccggctacgggaaggtcgcggccgccgccctgtcagccgcctcggcgcccccaggacccctcgggtctctttaaccggaagcggaagtgcgtgtcggcgggatcatggcgactttggtcgaactgccggactcggtcctgctcgagatcttctcttacctcccggtacgggaccggatccgcatctccagggtctgtcaccgctggaagaggctggtggacgaccggtggctgtggcgacatgtcgacctgacgctctacacggccctatgatgccaagtagagaaatccagcaataaaaggcagatatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaatgccggccctggagagtctgtgcctgcagggtcccctcgtcaccccagaaatgccctcccccactgaaatcctctcctcctgcctcactatgcccaagctcagagtccttgagctgcaggggctggggtgggagggtcaggaggcggagaagatcctgtgtaaggggctgccccactgtatggtcatcgtcagggcttgccccaaagagtctatggactggtggatgtaactactccacctgcccttgggacccatcccagttttcatcattgagccccagaccctctgagcagcaccttgaagagggcagataatcagacttgaggaaactgaaagccccaggttgagagaacagaggcctagggacctccagaccattggaatcactgtttgccagctgtgtggccttggtcatatcatcagcctctgggaagcctagttcccacatctggaaataaggatgatcatagctacctcacggttacattgcaaagccttactctaaaagctcccagcctccagaggctctcaatgaagagtcaccttcatggtcgtcttcaggaacaggacggatgaagaaggggtggggttaagactcaggggcacctgagggtctgagcccccttatgagtacccaagaaggactgtctatgcatgcacacccacaagcctatacaccatttatatacctacacgcacgcaagagacgcggagagataggcgatgcagactcgcgattcaatgatcgatatgctcataaaagtgctcaattatattttctgtattttgtatgctgtattttccaagacgtatattattttactattaaagaaaaaaatcatttttttttcccgaaaaaaaaaaa

SEQ ID NO: 300934 - DNA, 1641 bp, Homo sapiens
  misc_feature (47)..(47): n is a, c, g, or t
cggtgactgagatcgtgccattgcactccagcctgggcaacaagcanaactccgtctcaaaaaaaaagaaaagaaaagaaacacctttgtaagcacacataaagaatatgttattagacaattttcctttttccattaggccctatgatgccaagtagagaaatccagcaataaaaggcagatatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaatgccggccctggagagtctgtgcctgcagggtcccctcgtcaccccagaaatgccctcccccactgaaatcctctcctcctgcctcactatgcccaagctcagagtccttgagctgcaggggctggggtgggagggtcaggaggcggagaagatcctgtgtaaggggctgccccactgtatggtcatcgtcagggcttgccccaaagagtctatggactggtggatgtaactactccacctgcccttgggacccatcccagttttcatcattgagccccagaccctctgagcagcaccttgaagagggcagataatcagacttgaggaaactgaaagccccaggttgagagaacagaggcctagggacctccagaccattggaatcactgtttgccagctgtgtggccttggtcatatcatcagcctctgggaagcctagttcccacatctggaaataaggatgatcatagctacctcacggttacattgcaaagccttactctaaaagctcccagcctccagaggctctcaatgaagagtcaccttcatggtcgtcttcaggaacaggacggatgaagaaggggtggggttaagactcaggggcacctgagggtctgagcccccttatgagtacccaagaaggactgtctatgcatgcacacccacaagcctatacaccatttatatacctacacgcacgcaagagacgcggagagataggcgatgcagactcgcgattcaatgatcgatatgctcataaaagtgctcaattatattttctgtattttgtatgctgtattttccaagacgtatattattttactattaaagaaaaaaatcatttttttttcccgaaaaaaaaaaa

SEQ ID NO: 300935 - DNA, 1861 bp, Homo sapiens
acttggtcttagttcccagtcgcggccaaatcacgcctcagccacctcccgcaagcctctcactgcctcagccacgctttccaggctggtttctggtccccatccgcggctggtccggccctgggaccgaatcacttcccagcgagaggaaggtcaaatttctcgaccggctacgggaaggtcgcggccgccgccctgtcagccgcctcggcgcccccaggacccctcgggtctctttaaccggaagcggaagtgcgtgtcggcgggatcatggcgactttggtcgaactgccggactcggtcctgctcgagatcttctcttacctcccgggtctgtcaccgctggaagaggctggtggacgaccggtggctgtggcgacatgtcgacctgacgctctacacgatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaatgccggccctggagagtctgtgcctgcagggtcccctcgtcaccccagaaatgccctcccccactgaaatcctctcctcctgcctcactatgcccaagctcagagtccttgagctgcaggggctggggtgggagggtcaggaggcggagaagatcctgtgtaaggggctgccccactgtatggtcatcgtcagggcttgccccaaagagtctatggactggtggatgtaactactccacctgcccttgggacccatcccagttttcatcattgagccccagaccctctgagcagcaccttgaagagggcagataatcagacttgaggaaactgaaagccccaggttgagagaacagaggcctagggacctccagaccattggaatcactgtttgccagctgtgtggccttggtcatatcatcagcctctgggaagcctagttcccacatctggaaataaggatgatcatagctacctcacggttacattgcaaagccttactctaaaagctcccagcctccagaggctctcaatgaagagtcaccttcatggtcgtcttcaggaacaggacggatgaagaaggggtggggttaagactcaggggcacctgagggtctgagcccccttatgagtacccaagaaggactgtctatgcatgcacacccacaagcctatacaccatttatatacctacacgcacgcaagagacgcggagagataggcgatgcagactcgcgattcaatgatcgatatgctcataaaagtgctcaattatattttctgtattttgtatgctgtattttccaagacgtatattattttactattaaagaaaaaaatcatttttttttcccgaaaaaaaaaaa

SEQ ID NO: 300936 - DNA, 1814 bp, Homo sapiens
acttggtcttagttcccagtcgcggccaaatcacgcctcagccacctcccgcaagcctctcactgcctcagccacgctttccaggctggtttctggtccccatccgcggctggtccggccctgggaccgaatcacttcccagcgagaggaaggtcaaatttctcgaccggctacgggaaggtcgcggccgccgccctgtcagccgcctcggcgcccccaggacccctcgggtctctttaaccggaagcggaagtgcgtgtcggcgggatcatggcgactttggtcgaactgccggactcggtcctgctcgagatcttctcttacctcccggtacgggaccggatccgcatctccagatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaatgccggccctggagagtctgtgcctgcagggtcccctcgtcaccccagaaatgccctcccccactgaaatcctctcctcctgcctcactatgcccaagctcagagtccttgagctgcaggggctggggtgggagggtcaggaggcggagaagatcctgtgtaaggggctgccccactgtatggtcatcgtcagggcttgccccaaagagtctatggactggtggatgtaactactccacctgcccttgggacccatcccagttttcatcattgagccccagaccctctgagcagcaccttgaagagggcagataatcagacttgaggaaactgaaagccccaggttgagagaacagaggcctagggacctccagaccattggaatcactgtttgccagctgtgtggccttggtcatatcatcagcctctgggaagcctagttcccacatctggaaataaggatgatcatagctacctcacggttacattgcaaagccttactctaaaagctcccagcctccagaggctctcaatgaagagtcaccttcatggtcgtcttcaggaacaggacggatgaagaaggggtggggttaagactcaggggcacctgagggtctgagcccccttatgagtacccaagaaggactgtctatgcatgcacacccacaagcctatacaccatttatatacctacacgcacgcaagagacgcggagagataggcgatgcagactcgcgattcaatgatcgatatgctcataaaagtgctcaattatattttctgtattttgtatgctgtattttccaagacgtatattattttactattaaagaaaaaaatcatttttttttcccgaaaaaaaaaaa

SEQ ID NO: 300937 - DNA, 1959 bp, Homo sapiens
acttggtcttagttcccagtcgcggccaaatcacgcctcagccacctcccgcaagcctctcactgcctcagccacgctttccaggctggtttctggtccccatccgcggctggtccggccctgggaccgaatcacttcccagcgagaggaaggtcaaatttctcgaccggctacgggaaggtcgcggccgccgccctgtcagccgcctcggcgcccccaggacccctcgggtctctttaaccggaagcggaagtgcgtgtcggcgggatcatggcgactttggtcgaactgccggactcggtcctgctcgagatcttctcttacctcccgggtctgtcaccgctggaagaggctggtggacgaccggtggctgtggcgacatgtcgacctgacgctctacacggctggagtgcagtggtatgatctcagctcactgcaacctctgcctcctgggttcaagtgattcccctgcctcagcctcctgagaagctgggactacagatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaatgccggccctggagagtctgtgcctgcagggtcccctcgtcaccccagaaatgccctcccccactgaaatcctctcctcctgcctcactatgcccaagctcagagtccttgagctgcaggggctggggtgggagggtcaggaggcggagaagatcctgtgtaaggggctgccccactgtatggtcatcgtcagggcttgccccaaagagtctatggactggtggatgtaactactccacctgcccttgggacccatcccagttttcatcattgagccccagaccctctgagcagcaccttgaagagggcagataatcagacttgaggaaactgaaagccccaggttgagagaacagaggcctagggacctccagaccattggaatcactgtttgccagctgtgtggccttggtcatatcatcagcctctgggaagcctagttcccacatctggaaataaggatgatcatagctacctcacggttacattgcaaagccttactctaaaagctcccagcctccagaggctctcaatgaagagtcaccttcatggtcgtcttcaggaacaggacggatgaagaaggggtggggttaagactcaggggcacctgagggtctgagcccccttatgagtacccaagaaggactgtctatgcatgcacacccacaagcctatacaccatttatatacctacacgcacgcaagagacgcggagagataggcgatgcagactcgcgattcaatgatcgatatgctcataaaagtgctcaattatattttctgtattttgtatgctgtattttccaagacgtatattattttactattaaagaaaaaaatcatttttttttcccgaaaaaaaaaaa

SEQ ID NO: 300938 - DNA, 2092 bp, Homo sapiens
acttggtcttagttcccagtcgcggccaaatcacgcctcagccacctcccgcaagcctctcactgcctcagccacgctttccaggctggtttctggtccccatccgcggctggtccggccctgggaccgaatcacttcccagcgagaggaaggtcaaatttctcgaccggctacgggaaggtcgcggccgccgccctgtcagccgcctcggcgcccccaggacccctcgggtctctttaaccggaagcggaagtgcgtgtcggcgggatcatggcgactttggtcgaactgccggactcggtcctgctcgagatcttctcttacctcccggtacgggaccggatccgcatctccagggtctgtcaccgctggaagaggctggtggacgaccggtggctgtggcgacatgtcgacctgacgctctacacgtagaaacggggttttgtcatgttggccaggatggtctcaatctcctgacctcgtgatccgcccgcatcggccttccaaagtgctgggattatgggcatgagccactgcgcccgggcttctttctcattttctcttgctgccgccatgtaagaagtgcctttcacctcctgccatgattttgaggcctccccagccatgtggaactatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaatgccggccctggagagtctgtgcctgcagggtcccctcgtcaccccagaaatgccctcccccactgaaatcctctcctcctgcctcactatgcccaagctcagagtccttgagctgcaggggctggggtgggagggtcaggaggcggagaagatcctgtgtaaggggctgccccactgtatggtcatcgtcagggcttgccccaaagagtctatggactggtggatgtaactactccacctgcccttgggacccatcccagttttcatcattgagccccagaccctctgagcagcaccttgaagagggcagataatcagacttgaggaaactgaaagccccaggttgagagaacagaggcctagggacctccagaccattggaatcactgtttgccagctgtgtggccttggtcatatcatcagcctctgggaagcctagttcccacatctggaaataaggatgatcatagctacctcacggttacattgcaaagccttactctaaaagctcccagcctccagaggctctcaatgaagagtcaccttcatggtcgtcttcaggaacaggacggatgaagaaggggtggggttaagactcaggggcacctgagggtctgagcccccttatgagtacccaagaaggactgtctatgcatgcacacccacaagcctatacaccatttatatacctacacgcacgcaagagacgcggagagataggcgatgcagactcgcgattcaatgatcgatatgctcataaaagtgctcaattatattttctgtattttgtatgctgtattttccaagacgtatattattttactattaaagaaaaaaatcatttttttttcccgaaaaaaaaaaa

SEQ ID NO: 300939 - DNA, 1788 bp, Homo sapiens
acttggtcttagttcccagtcgcggccaaatcacgcctcagccacctcccgcaagcctctcactgcctcagccacgctttccaggctggtttctggtccccatccgcggctggtccggccctgggaccgaatcacttcccagcgagaggaaggtcaaatttctcgaccggctacgggaaggtcgcggccgccgccctgtcagccgcctcggcgcccccaggacccctcgggtctctttaaccggaagcggaagtgcgtgtcggcgggatcatggcgactttggtcgaactgccggactcggtcctgctcgagatcttctcttacctcccgatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaatgccggccctggagagtctgtgcctgcagggtcccctcgtcaccccagaaatgccctcccccactgaaatcctctcctcctgcctcactatgcccaagctcagagtccttgagctgcaggggctggggtgggagggtcaggaggcggagaagatcctgtgtaaggggctgccccactgtatggtcatcgtcagggcttgccccaaagagtctatggactggtggatgtaactactccacctgcccttgggacccatcccagttttcatcattgagccccagaccctctgagcagcaccttgaagagggcagataatcagacttgaggaaactgaaagccccaggttgagagaacagaggcctagggacctccagaccattggaatcactgtttgccagctgtgtggccttggtcatatcatcagcctctgggaagcctagttcccacatctggaaataaggatgatcatagctacctcacggttacattgcaaagccttactctaaaagctcccagcctccagaggctctcaatgaagagtcaccttcatggtcgtcttcaggaacaggacggatgaagaaggggtggggttaagactcaggggcacctgagggtctgagcccccttatgagtacccaagaaggactgtctatgcatgcacacccacaagcctatacaccatttatatacctacacgcacgcaagagacgcggagagataggcgatgcagactcgcgattcaatgatcgatatgctcataaaagtgctcaattatattttctgtattttgtatgctgtattttccaagacgtatattattttactattaaagaaaaaaatcatttttttttcccgaaaaaaaaaaa

SEQ ID NO: 300940 - DNA, 1648 bp, Homo sapiens
acttggtcttagttcccagtcgcggccaaatcacgcctcagccacctcccgcaagcctctcactgcctcagccacgctttccaggctggtttctggtccccatccgcggctggtccggccctgggaccgaatcacttcccagcgagaggaaggtcaaatttctcgaccggctacgggaaggtcgcggccgccgccctgtcagccgcctcggcgcccccaggacccctcgggtctctttaaccggaagcggaagtgcgtgtcggcgggatcatggcgactttggtcgaactgccggactcgccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaatgccggccctggagagtctgtgcctgcagggtcccctcgtcaccccagaaatgccctcccccactgaaatcctctcctcctgcctcactatgcccaagctcagagtccttgagctgcaggggctggggtgggagggtcaggaggcggagaagatcctgtgtaaggggctgccccactgtatggtcatcgtcagggcttgccccaaagagtctatggactggtggatgtaactactccacctgcccttgggacccatcccagttttcatcattgagccccagaccctctgagcagcaccttgaagagggcagataatcagacttgaggaaactgaaagccccaggttgagagaacagaggcctagggacctccagaccattggaatcactgtttgccagctgtgtggccttggtcatatcatcagcctctgggaagcctagttcccacatctggaaataaggatgatcatagctacctcacggttacattgcaaagccttactctaaaagctcccagcctccagaggctctcaatgaagagtcaccttcatggtcgtcttcaggaacaggacggatgaagaaggggtggggttaagactcaggggcacctgagggtctgagcccccttatgagtacccaagaaggactgtctatgcatgcacacccacaagcctatacaccatttatatacctacacgcacgcaagagacgcggagagataggcgatgcagactcgcgattcaatgatcgatatgctcataaaagtgctcaattatattttctgtattttgtatgctgtattttccaagacgtatattattttactattaaagaaaaaaatcatttttttttcccgaaaaaaaaaaa

SEQ ID NO: 300941 - DNA, 1782 bp, Homo sapiens
acttggtcttagttcccagtcgcggccaaatcacgcctcagccacctcccgcaagcctctcactgcctcagccacgctttccaggctggtttctggtccccatccgcggctggtccggccctgggaccgaatcacttcccagcgagaggaaggtcaaatttctcgaccggctacgggaaggtcgcggccgccgccctgtcagccgcctcggcgcccccaggacccctcgggtctctttaaccggaagcggaagtgcgtgtcggcgggatcatggcgactttggtcgaactgccggactcggtcctgctcgagatcttctcttacctcccggtacgggaccggatccgcatctccagggtctgtcaccgctggaagaggctggtggacgaccggtggctgtggcgacatgtcgacctgacgctctacacgatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaatgccggccctggagagtctgtgcctgcagggtcccctcgtcaccccagaaatgccctcccccactgaaatcctctcctcctgcctcactatgcccaagctcagagtccttgagctgcaggggctggggtgggagggtcaggaggcggagaagatcctgtgtaaggggctgccccactgtatggtcatcgtcagggcttgccccaaagagtctatggactggtggatgtaactactccacctgcccttgggacccatcccagttttcatcattgagccccagaccctctgagcagcaccttgaagagggcagataatcagactctgggaagcctagttcccacatctggaaataaggatgatcatagctacctcacggttacattgcaaagccttactctaaaagctcccagcctccagaggctctcaatgaagagtcaccttcatggtcgtcttcaggaacaggacggatgaagaaggggtggggttaagactcaggggcacctgagggtctgagcccccttatgagtacccaagaaggactgtctatgcatgcacacccacaagcctatacaccatttatatacctacacgcacgcaagagacgcggagagataggcgatgcagactcgcgattcaatgatcgatatgctcataaaagtgctcaattatattttctgtattttgtatgctgtattttccaagacgtatattattttactattaaagaaaaaaatcatttttttttcccgaaaaaaaaaaa

SEQ ID NO: 300942 - DNA, 1491 bp, Homo sapiens
acttggtcttagttcccagtcgcggccaaatcacgcctcagccacctcccgcaagcctctcactgcctcagccacgctttccaggctggtttctggtccccatccgcggctggtccggccctgggaccgaatcacttcccagcgagaggaaggtcaaatttctcgaccggctacgggaaggtcgcggccgccgccctgtcagccgcctcggcgcccccaggacccctcgggtctctttaaccggaagcggaagtgcgtgtcggcgggatcatggcgactttggtcgaactgccggactcggtcctgctcgagatcttctcttacctcccggtacgggaccggatccgcatctccagggtctgtcaccgctggaagaggctggtggacgaccggtggctgtggcgacatgtcgacctgacgctctacacggtacgcgcagctggccgggcgggcctgggccgcggtcgcggtgcccggaccccgaagaccacctctcccaccctgggactgtgtgtcggggcccgggctggggatttagagccaggcgatccggggcctatctcggcatcatcgcttaccagctcctcttcgacctcagggcctcaatttcctcatccctgcaatggggataaaggacagtacctgcctcacggggctattatgggacttcactgagatcacgcagggaaagggcttagaacagtctggcacatatttatcattcgataaatgctaatttatgactatgttatcaagtttttgttttgtttttgagacagagtctcgctctgctgctcaggctggagtgcagtggtgcgattgcagcctcgacctcccaagctcaagcgatcctctcgcatcagcctcctgagtagctggaaccacgggcgctcgccactacacctgctaattttttattttttgtagagacggagtctcactatgctgcccaggctggtctcgaactcctgggctcaagtgattctcccgacttagcctcccaaagtgttcagattacaggcatgagccacagcaactggctcaaaacatttatagatatatttgttgccctttttgaaactgtcttcatagataattgctattataaagtgaatttgcacccttccttttacgttacttcatatgtgtgtgtccaaaaacaattatagtgttagtaatgtatttctgaacttcgggtaatgctgttctactatttagatagtgttctacttttaaacaattttactgtatatatccatctgtaactccctttaatacagttgcttttgaagttctttttttaaggacagagtcttgctatgttgcccaggatggtctcgaactcctggactgaagctgtcccccaacctcagtctcccaaagtgctgggattacaggtgtgagccacagtgtctggcctgataatatgaaactttttctcagttgttgaaacttagttgttggttttgcgaggaaaagttgattcgtcca

SEQ ID NO: 300943 - DNA, 2474 bp, Homo sapiens
agcgtggagcagctaatcctcacagacctgtaggagctggagtgggagctcaagcaggattcttcccgagtccctggcatcctcagaagcttcaactctggaggcaatgggtcgaaaggaagaagatgactgcagttcctggaagaaacagaccaccaacatccggaaaaccttcatttttatggaagtgctgggatcaggagctttctcagaagttttcctggtgaagcaaagactgactgggaagctctttgctctgaagtgcatcaagaagtcacctgccttccgggacagcagcctggagaatgagattgctgtgttgaaaaagatcaagcatgaaaacattgtgaccctggaggacatctatgagagcaccacccactactacctggtcatgcagcttgtttctggtggggagctctttgaccggatcctggagcggggtgtctacacagagaaggatgccagtctggtgatccagcaggtcttgtcggcagtgaaatacctacatgagaatggcatcgtccacagagacttaaagcccgaaaacctgctttaccttacccctgaagagaactctaagatcatgatcactgactttggtctgtccaagatggaacagaatggcatcatgtccactgcctgtgggaccccaggctacgtggctccagaagtgctggcccagaaaccctacagcaaggctgtggattgctggtccatcggcgtcatcacctacatattgctctgtggataccccccattctatgaagaaacggagtctaagcttttcgagaagatcaaggagggctactatgagtttgagtctccattctgggatgacatttctgagtcagccaaggactttatttgccacttgcttgagaaggatccgaacgagcggtacacctgtgagaaggccttgagtcatccctggattgacggaaacacagccctccaccgggacatctacccatcagtcagcctccagatccagaagaactttgctaagagcaagtggaggcaagccttcaacgcagcagctgtggtgcaccacatgaggaagctacacatgaacctgcacagcccgggcgtccgcccagaggtggagaacaggccgcctgaaactcaagcctcagaaacctctagacccagctcccctgagatcaccatcaccgaggcacctgtcctggaccacagtgtagcactccctgccctgacccaattaccctgccagcatggccgccggcccactgcccctggtggcaggtccctcaactgcctggtcaatggctccctccacatcagcagcagcctggtgcccatgcatcaggggtccctggccgccgggccctgtggctgctgctccagctgcctgaacattgggagcaaaggaaagtcctcctactgctctgagcccacactcctcaaaaaggccaacaaaaaacagaacttcaagtcggaggtcatggtaccagttaaagccagtggcagctcccactgccgggcagggcagactggagtctgtctcattatgtgattcctggagcctgtgcctatgtcactgcaattttcaggagacatattcaactcctctgctcttccaaacctggtgtctatccggcagagggaggaaggcagagcaagtggagcagggcttagcaggagcagtttctggccagaagcaccagcctgctgccagcggggcagcccctcataggaggcccaggagggagccccaaggcgtagaagccttgttgaagctgtgagcaggagaagcggtgcccaccagcttccaggtctccctgacctgcctgctctatgccccacaccctacgtgccgtggctctgtgcagtgtacgtagatagctctcgcctgggtctgtgctgtttgtcgtgaaaagcttaatgggctggccaggctgtgtcaccttctccaagcaaagccatatggagcatctacccagactcccactctgcacacactcactcccacctctcaagcctccaacctcttggccagattgggctcattaatgtcgttgcctgcccatctgcatgaatgacaggcagctccccatggtggtctgcctgtgagctcttcaagttctaatccttaactccaggattagctcccaagtgcgctgagacccagccagcacacttctggcccttctccctgcctcaatctaaaagcagtgccacaccctccaaagtggaatagaaagaagttcatgagtaagggctgcaaggaattcttatcctggccacatgtcctccgtgcacacacccaatggagttaaccttggaagttgactattttaatgtctgccaggagttctaatcctgcctctgttcccttttctctccttgaaagtccagcacaccattcttgtccttccccagtttcctcgccctccacccctccagcttcatgctcagtgttgtgcttaataaaatggacatatttttctcta

SEQ ID NO: 300944 - DNA, 2398 bp, Homo sapiens
agcgtggagcagctaatcctcacagacctgtaggagctggagtgggagctcaagcaggattcttcccgagtccctggcatcctcagaagcttcaactctggaggcaatgggtcgaaaggaagaagatgactgcagttcctggaagaaacagaccaccaacatccggaaaaccttcatttttatggaagtgctgggatcaggagctttctcagaagttttcctggtgaagcaaagactgactgggaagctctttgctctgaagtgcatcaagaagtcacctgccttccgggacagcagcctggagaatgagattgctgtgttgaaaaagatcaagcatgaaaacattgtgaccctggaggacatctatgagagcaccacccactactacctggtcatgcagcttgtttctggtggggagctctttgaccggatcctggagcggggtgtctacacagagaaggatgccagtctggtgatccagcaggtcttgtcggcagtgaaatacctacatgagaatggcatcgtccacagagacttaaagcccgaaaacctgctttaccttacccctgaagagaactctaagatcatgatcactgactttggtctgtccaagatggaacagaatggcatcatgtccactgcctgtgggaccccaggctacgtgggctctgtggataccccccattctatgaagaaacggagtctaagcttttcgagaagatcaaggagggctactatgagtttgagtctccattctgggatgacatttctgagtcagccaaggactttatttgccacttgcttgagaaggatccgaacgagcggtacacctgtgagaaggccttgagtcatccctggattgacggaaacacagccctccaccgggacatctacccatcagtcagcctccagatccagaagaactttgctaagagcaagtggaggcaagccttcaacgcagcagctgtggtgcaccacatgaggaagctacacatgaacctgcacagcccgggcgtccgcccagaggtggagaacaggccgcctgaaactcaagcctcagaaacctctagacccagctcccctgagatcaccatcaccgaggcacctgtcctggaccacagtgtagcactccctgccctgacccaattaccctgccagcatggccgccggcccactgcccctggtggcaggtccctcaactgcctggtcaatggctccctccacatcagcagcagcctggtgcccatgcatcaggggtccctggccgccgggccctgtggctgctgctccagctgcctgaacattgggagcaaaggaaagtcctcctactgctctgagcccacactcctcaaaaaggccaacaaaaaacagaacttcaagtcggaggtcatggtaccagttaaagccagtggcagctcccactgccgggcagggcagactggagtctgtctcattatgtgattcctggagcctgtgcctatgtcactgcaattttcaggagacatattcaactcctctgctcttccaaacctggtgtctatccggcagagggaggaaggcagagcaagtggagcagggcttagcaggagcagtttctggccagaagcaccagcctgctgccagcggggcagcccctcataggaggcccaggagggagccccaaggcgtagaagccttgttgaagctgtgagcaggagaagcggtgcccaccagcttccaggtctccctgacctgcctgctctatgccccacaccctacgtgccgtggctctgtgcagtgtacgtagatagctctcgcctgggtctgtgctgtttgtcgtgaaaagcttaatgggctggccaggctgtgtcaccttctccaagcaaagccatatggagcatctacccagactcccactctgcacacactcactcccacctctcaagcctccaacctcttggccagattgggctcattaatgtcgttgcctgcccatctgcatgaatgacaggcagctccccatggtggtctgcctgtgagctcttcaagttctaatccttaactccaggattagctcccaagtgcgctgagacccagccagcacacttctggcccttctccctgcctcaatctaaaagcagtgccacaccctccaaagtggaatagaaagaagttcatgagtaagggctgcaaggaattcttatcctggccacatgtcctccgtgcacacacccaatggagttaaccttggaagttgactattttaatgtctgccaggagttctaatcctgcctctgttcccttttctctccttgaaagtccagcacaccattcttgtccttccccagtttcctcgccctccacccctccagcttcatgctcagtgttgtgcttaataaaatggacatatttttctcta

SEQ ID NO: 300945 - DNA, 272 bp, Homo sapiens
ctctgaaatgagaagtgggcacccaggtttcaagaggccacaaggcaaagggaaagtttaagctccaaggccctctgaggttgcagaaggccagaggctgctcttgtgtctccttagcaagccttcaacgcagcagctgtggtgcaccacatgaggaagctacacatgaacctgcacagcccgggcgtccgcccagaggtggagaacaggccgcctgaaactcaagcctcagaaacctctagacccagctcccctgagatcaccatcaccga

SEQ ID NO: 300946 - DNA, 426 bp, Homo sapiens
caactttcttaaacatattttatatagcattcataagtcagggaaagtataaggagaggtggcaagggttggagggcataatgtacacagggaccttctagggatgactgtgccaaggcttggcacttgcataaacactttacgggacctgtaccattctggaatttgaggcagatctgcgtcctggtcacaccactgttctgggaccttcagtgcccacctgtgtatacagtgggagcttgggggagcagagaggctggctcagggaggacaggtttgttcagtagtatgcctccttcctgtcctgctgcaggctctgtggataccccccattctatgaagaaacggagtctaagcttttcgagaagatcaaggagggctactatgagtttgagtctccattctgggatgacatttctgagtcag

SEQ ID NO: 300947 - DNA, 1276 bp, Homo sapiens
tggttgtaaagtttagttttaatatttatttattttttttttttgaggagtctcgctctgtcgcccaggctagatagagtgcagtggcacgatcttggctcactgtagcctctgcctccaaggttcaagtgattctcctgcctcagcctcccaaaatgctgggattacaggtgtgagccaccacctgtataagtttaatgtttaaaagttttaatggttgtaaaagtttacttcttaagtagaaaatggttatcttttacttagtttgtagagatgactgtttcaagataggactaactggagatacgtctggctacttaaaatatggtaactagttgtaacatctttaattagttattttttcaaggccaaggtatggtggtagtttgctaggctcataggcttctaggagaaattatagattcaaggtttcaactcaaggagttggattttattctcactactttcttaggcagaatgacatgatgcttattctgcaaacactccaattaaaggctttatgtgactgatgtgaaactaaaaagttagactggtttaatttttagctgtcctcctccattacataacattttgcattcttaagtcatagtcttaactactgctttaatttgcaggatgagtctgaatgtacttcagatgaggaaatctttatctcacaagatgaaatacagtcatttatggctaataaccagtctttctacagcaatagagaacaataccgacagcatctgaaggagaaatttaataaatactgccggttaaatgatcacaagaggcccatttgtagtggctggttgacaacggctggagcaaattaaataaataaaatagctctgtctttcaatgaaacactcacgatgactactgcgccttctctttcgaaaaactcttaatttagtgacttatggcaaaattttatcttaaatcaatgtgattctttcttgttttgggagacggtggaggtatcctcattagttctttcttcaggcttgtgtctttagttgcgtggctgcgcaggcctgccatatgatttaagccatctcttttcattaaatgtttctcttcctgtgagacttactaaagcaacttagtggcaaaaagtaatgttgtacttataattctgtacagaaatgacaatgagctgaatatatggttttacaaagtagacatccacttgcaaaatgtttggatgtaatgttaaagcgcaatgtgcaaaatttaaaataaagaatatttattaatacgcacagtaaaa

SEQ ID NO: 300948 - DNA, 2803 bp, Homo sapiens
gcgagcggctgactgcccgtagaggaaacgacattcggagctgcgctcccgcccaggccggccctgacgcgggcctcgtcagccagtaacagggagcagaggtgggagttagcgaggcgaccacgaaaacggtgaaggtcggaaccgacagcctcctccgagaagggcaggagctgggaggaggcggcagcggcggcggcagaaacagcagcggcggcggcggcggcagctgggaggaggtggtgacggtggcaacggcagcgtcggggacgatggcgcgactcgtggcagtgtgcagggacggggaggaggagttccccttcgagaggaggcagattcccctctacatagacgacaccctgacgatggtgatggaatttcctgataatgtgttaaatctcgatggacatcagaataatggtgcacagctaaagcagttcattcagcgacatggtatgcttaagcaacaggatctaagtattgccatggtggtgacatcacgcgaagtcctgagtgcactttctcagcttgtcccatgtgttggttgtcgtcgcagtgtggagcgtctcttttcccagcttgtagagtctggaaatcctgctcttgaacccctaacagtagggcccaagggagtcctgtctgtaactagaagctgcatgactgatgcaaagaagctttatacattattttatgtacatgggtccaaactaaatgacatgatagatgctattccaaaaagtaagaagaataagagatgtcagttgcactccttagatacgcacaagccaaaacctttgggaggttgttggatggatgtatgggaactaatgtcgcaggaatgcagggatgaagtagttttaattgactcgagttgtcttttagaaacactagaaacatatctgcgaaaacacaggttttgcactgattgcaaaaataaagtcctccgagcatacaatatccttattggtgaacttgactgcagcaaagaaaagggctactgtgctgcactttatgaaggcttgcggtgctgtccacatgaacgacacatacatgtttgctgtgaaacagacttcattgcacatcttttgggtcgtgctgagccagagttcgcaggagggcgaagagaaaggcatgcaaagacaatagatatagctcaagaagaagttctgacctgcttgggaattcatctttatgaaagactgcatcgaatctggcagaagctacgggcagaagagcagacatggcagatgcttttctatcttggtgttgatgctttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaaggaaacagacttcatagaaaatagcagctgcaaagcctgtggcagcactgaagatggtaatacttgtgtagaagtaattgttaccaatgaaaatacatcatgtacctgtcctagcagtggcaatcttttggggtcccctaaaataaagaaaggcttatctccacactgtaatggtagtgattgtggatattcatctagcatggaagggagtgaaacaggttctcgggagggttcggatgttgcctgcactgaaggcatttgtaatcatgatgaacacggtgatgactcttgtgttcatcactgtgaagacaaagaggatgatggtgatagttgtgttgaatgttgggcaaattctgaagagaacgacacaaaaggaaaaaataaaaagaagaaaaagaaaagcaagatactgaaatgtgatgaacatatccagaagcttggaagctgtattacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgatgagtctgaatgtacttcagatgaggaaatctttatctcacaagatgaaatacagtcatttatggctaataaccagtctttctacagcaatagagaacaataccgacagcatctgaaggagaaatttaataaatactgccggttaaatgatcacaagaggcccatttgtagtggctggttgacaacggctggagcaaattaaataaataaaatagctctgtctttcaatgaaacactcacgatgactactgcgccttctctttcgaaaaactcttaatttagtgacttatggcaaaattttatcttaaatcaatgtgattctttcttgttttgggagacggtggaggtatcctcattagttctttcttcaggcttgtgtctttagttgcgtggctgcgcaggcctgccatatgatttaagccatctcttttcattaaatgtttctcttcctgtgagacttactaaagcaacttagtggcaaaaagtaatgttgtacttataattctgtacagaaatgacaatgagctgaatatatggttttacaaagtagacatccacttgcaaaatgtttggatgtaatgttaaagcgcaatgtgcaaaatttaaaataaagaatatttattaatacgcacagtaaaa

SEQ ID NO: 300949 - DNA, 3484 bp, Homo sapiens
  misc_feature (1756)..(1756): n is a, c, g, or t
  misc_feature (1814)..(1814): n is a, c, g, or t
  misc_feature (3014)..(3014): n is a, c, g, or t
  misc_feature (3168)..(3168): n is a, c, g, or t
  misc_feature (3176)..(3176): n is a, c, g, or t
  misc_feature (3478)..(3478): n is a, c, g, or t
gcgagcggctgactgcccgtagaggaaacgacattcggagctgcgctcccgcccaggccggccctgacgcgggcctcgtcagccagtaacagggagcagaggtgggagttagcgaggcgaccacgaaaacggtgaaggtcggaaccgacagcctcctccgagaagggcaggagctgggaggaggcggcagcggcggcggcagaaacagcagcggcggcggcggcggcagctgggaggaggtggtgacggtggcaacggcagcgtcggggacgatggcgcgactcgtggcagtgtgcagggacggggaggaggagttccccttcgagaggaggcagattcccctctacatagacgacaccctgacgatggtgatggaatttcctgataatgtgttaaatctcgatggacatcagaataatggtgcacagctaaagcagttcattcagcgacatggtatgcttaagcaacaggatctaagtattgccatggtggtgacatcacgcgaagtcctgagtgcactttctcagcttgtcccatgtgttggttgtcgtcgcagtgtggagcgtctcttttcccagcttgtagagtctggaaatcctgctcttgaacccctaacagtagggcccaagggagtcctgtctgtaactagaagctgcatgactgatgcaaagaagctttatacattattttatgtacatgggtccaaactaaatgacatgatagatgctattccaaaaagtaagaagaataagagatgtcagttgcactccttagatacgcacaagccaaaacctttgggaggttgttggatggatgtatgggaactaatgtcgcaggaatgcagggatgaagtagttttaattgactcgagttgtcttttagaaacactagaaacatatctgcgaaaacacaggttttgcactgattgcaaaaataaagtcctccgagcatacaatatccttattggtgaacttgactgcagcaaagaaaagggctactgtgctgcactttatgaaggcttgcggtgctgtccacatgaacgacacatacatgtttgctgtgaaacagacttcattgcacatcttttgggtcgtgctgagccagagttcgcaggagggtatgagtatgtaatttgctagaatgggctatctagcgctttgcttcattttattactgaaagtttattttcatcaccttctgcctcagtacatatgatatatgtataaattaaagtatgcctgtaaagattttgcttctctttaaagtatgcatttcttaattgactgaaaatagggaaaaactgttctctggtgtttggttcagtcctctgctagttcttgcttgaagggaggcaggcttttttggctttcattgttacagactatcattttcatttgaaaatgattagaagggatttttctccctctatccatgcattatcatgtgtaaattttattcacaataatggtttttgcataagtcagatctttgcagtaggggattaagaaatgccttattgaatgtaattcacgaactgtgtatattatattattattactacacagaaacctaaagtagtatctctggctttgttgtaaaaataaaatcagatgatgatgttaatagaataaatcaaatgcatttccttttgtatttagggtatcaaccctcatttgagtgcctactttctgctagaatacaaagggcttttttatcgccaaagttctgtgaacacttgtaaagactggcctggtgnaggactcttgcccatgatgaatcactttggcattgcctttctcaattcctcctcaaancaaaaaacctaaagaaggaaaaaatgttttgctataattggaaagtaaaaggaactgttgtgtctactatgagctggacacttctatgtgattgctttgtgccctaaaacccatctttttagagccagttcctgaattactttatttttagcaatacgaggactaaattctacttgcatgtgtatttctcattggttgtggacatgcatgcttgtatagcaacatatacgttgagtgtaaatgtataactgtcttgttactaggtaagcacattgtgtttaaaacctgaacttgcagctgtgttatccatcttttactgtttcagttaaaggtattagtgtgtgattattcccttttataggcgaagagaaaggcatgcaaagacaatagatatagctcaagaagaagttctgacctgcttgggaattcatctttatgaaagactgcatcgaatctggcagaagctacgggcagaagagcagacatggcagatgcttttctatcttggtgttgatgctttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaaggtaatatttcttaatatcaactcttaagtgtgtatgtattgcttgtagatagaagtacaggccaggtgtggtggctcacgcctgtgatcccagcactttgggaggcccagggtggaggtatcacttgagcctaggagtttgggaccagcctgggcaagatagtgagatctctatctctatttattttattttatttttttaataaaaataaaaagtacagtcgtcccttggtatctgtggggtttgattccaggacttcctgtagataccaaaatctgcagatgtgcaagtccctgatgtaaaatggtgtaatatttgcatatagtctatgcacatcctccttatacttttatttctgagacagggtctcactctgtcacccggactggagtgcagtggcacaatcatggctcactgcagcgttcatctcccaggctcatgtcatcttcccacctcagcttcccaagtngctggaactacaggcttaccccaccaggcccagctaattttttgtatttattgtagagatggcgttttaccatgttgttcaggctggtctccagcttgtgggctcaagcaattctcccacctcagcctcccaaaatgctacaattacaggcatnaaccaccntgcctggcctcttgtattcttaaattatctctaaattataatacctaatgcaatgtaaaagctatgtaaggctgggcatggtggctcacgcctgtaatcccagctacttgggaggctgaggcatgagaatttcttgaacccaggaggcaaaggttgcagtgagccaagatcgctccactgcagtccagcctgggcgacagagtgaaactctctcaaaataaataaaaactgtttaaatagttgttatactgtattgtttagaaaataaggacaagaaaaaagtctgtacatgttcagtacanatgcag

SEQ ID NO: 300950 - DNA, 660 bp, Homo sapiens
aaagaataattgctattatatcatgcctttttacctgtgaaatcctttgctgtggtatcagatccagaagcttggaagctgtattacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgtaagtattccatgtggtcttactgtacataactgtttgggaacggggtggatgtgggaggggatagtatttgagggcttaaggtaggtagttgaaggaagcttatgagaaattaagggtagtatttcattattgtttggggacttcatttctgtccttccactcgtggtttatgcaactactctggaacacgtttccatggccgcctctgtctcagtagaagacattataggtattccttgagttacagtggggttacattccaataaacccattataactcaaaaatactgcgagttgaaaatacattcaacatcccaataaaccctttgtaaagttaaaaaaaaaaa

SEQ ID NO: 300951 - DNA, 448 bp, Homo sapiens
tctaccattttcgcagagtattctatctggtgtagatgcttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaaggaaacagacttcatagaaaatagcagctgcaaagcctgtggcagcactgaagatggtaatacttgtgtagaagtaattgttaccaatgaaaatacatcatgtacctgtcctagcagtggcaatcttttggggtcccctaaaataaagaaaggcttatctccacactgtaatggtagaaccgacggggtaccgagca

SEQ ID NO: 300952 - DNA, 454 bp, Homo sapiens
tgccggtcactagaggacccccagtttcatcagtactgaaggcatttgtaatcatgatgaacacggtgatgactcttgtgttcatcactgtgaagacaaagaggatgatggtgatagttgtgttgaatgttgggcaaattctgaagagaacgacacaaaaggaaaaaataaaaagaagaaaaagaaaagcaagatactgaaatgtgatgaacatgtaagtgtcataacttgtaattcttaaacctttgctgttgaggacagaacacgtgttttccttggagtggcatatgtgcagcttagctgctaggatttactttttttagaatgagttctttttgcagttccattgggtgctcatcgtgtgagagtgtgggttgggggcagagagagatgtgatcatttgtgcaacagtccttgtgagtcagaaattcaattgttctttttatacttttaa

SEQ ID NO: 300953 - DNA, 3861 bp, Homo sapiens
  misc_feature (1756)..(1756): n is a, c, g, or t
  misc_feature (1814)..(1814): n is a, c, g, or t
gcgagcggctgactgcccgtagaggaaacgacattcggagctgcgctcccgcccaggccggccctgacgcgggcctcgtcagccagtaacagggagcagaggtgggagttagcgaggcgaccacgaaaacggtgaaggtcggaaccgacagcctcctccgagaagggcaggagctgggaggaggcggcagcggcggcggcagaaacagcagcggcggcggcggcggcagctgggaggaggtggtgacggtggcaacggcagcgtcggggacgatggcgcgactcgtggcagtgtgcagggacggggaggaggagttccccttcgagaggaggcagattcccctctacatagacgacaccctgacgatggtgatggaatttcctgataatgtgttaaatctcgatggacatcagaataatggtgcacagctaaagcagttcattcagcgacatggtatgcttaagcaacaggatctaagtattgccatggtggtgacatcacgcgaagtcctgagtgcactttctcagcttgtcccatgtgttggttgtcgtcgcagtgtggagcgtctcttttcccagcttgtagagtctggaaatcctgctcttgaacccctaacagtagggcccaagggagtcctgtctgtaactagaagctgcatgactgatgcaaagaagctttatacattattttatgtacatgggtccaaactaaatgacatgatagatgctattccaaaaagtaagaagaataagagatgtcagttgcactccttagatacgcacaagccaaaacctttgggaggttgttggatggatgtatgggaactaatgtcgcaggaatgcagggatgaagtagttttaattgactcgagttgtcttttagaaacactagaaacatatctgcgaaaacacaggttttgcactgattgcaaaaataaagtcctccgagcatacaatatccttattggtgaacttgactgcagcaaagaaaagggctactgtgctgcactttatgaaggcttgcggtgctgtccacatgaacgacacatacatgtttgctgtgaaacagacttcattgcacatcttttgggtcgtgctgagccagagttcgcaggagggtatgagtatgtaatttgctagaatgggctatctagcgctttgcttcattttattactgaaagtttattttcatcaccttctgcctcagtacatatgatatatgtataaattaaagtatgcctgtaaagattttgcttctctttaaagtatgcatttcttaattgactgaaaatagggaaaaactgttctctggtgtttggttcagtcctctgctagttcttgcttgaagggaggcaggcttttttggctttcattgttacagactatcattttcatttgaaaatgattagaagggatttttctccctctatccatgcattatcatgtgtaaattttattcacaataatggtttttgcataagtcagatctttgcagtaggggattaagaaatgccttattgaatgtaattcacgaactgtgtatattatattattattactacacagaaacctaaagtagtatctctggctttgttgtaaaaataaaatcagatgatgatgttaatagaataaatcaaatgcatttccttttgtatttagggtatcaaccctcatttgagtgcctactttctgctagaatacaaagggcttttttatcgccaaagttctgtgaacacttgtaaagactggcctggtgnaggactcttgcccatgatgaatcactttggcattgcctttctcaattcctcctcaaancaaaaaacctaaagaaggaaaaaatgttttgctataattggaaagtaaaaggaactgttgtgtctactatgagctggacacttctatgtgattgctttgtgccctaaaacccatctttttagagccagttcctgaattactttatttttagcaatacgaggactaaattctacttgcatgtgtatttctcattggttgtggacatgcatgcttgtatagcaacatatacgttgagtgtaaatgtataactgtcttgttactaggtaagcacattgtgtttaaaacctgaacttgcagctgtgttatccatcttttactgtttcagttaaaggtattagtgtgtgattattcccttttataggcgaagagaaaggcatgcaaagacaatagatatagctcaagaagaagttctgacctgcttgggaattcatctttatgaaagactgcatcgaatctggcagaagctacgggcagaagagcagacatggcagatgcttttctatcttggtgttgatgctttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaaggaaacagacttcatagaaaatagcagctgcaaagcctgtggcagcactgaagatggtaatacttgtgtagaagtaattgttaccaatgaaaatacatcatgtacctgtcctagcagtggcaatcttttggggtcccctaaaataaagaaaggcttatctccacactgtaatggtagtgattgtggatattcatctagcatggaagggagtgaaacaggttctcgggagggttcggatgttgcctgcactgaaggcatttgtaatcatgatgaacacggtgatgactcttgtgttcatcactgtgaagacaaagaggatgatggtgatagttgtgttgaatgttgggcaaattctgaagagaacgacacaaaaggaaaaaataaaaagaagaaaaagaaaagcaagatactgaaatgtgatgaacatatccagaagcttggaagctgtattacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgatgagtctgaatgtacttcagatgaggaaatctttatctcacaagatgaaatacagtcatttatggctaataaccagtctttctacagcaatagagaacaataccgacagcatctgaaggagaaatttaataaatactgccggttaaatgatcacaagaggcccatttgtagtggctggttgacaacggctggagcaaattaaataaataaaatagctctgtctttcaatgaaacactcacgatgactactgcgccttctctttcgaaaaactcttaatttagtgacttatggcaaaattttatcttaaatcaatgtgattctttcttgttttgggagacggtggaggtatcctcattagttctttcttcaggcttgtgtctttagttgcgtggctgcgcaggcctgccatatgatttaagccatctcttttcattaaatgtttctcttcctgtgagacttactaaagcaacttagtggcaaaaagtaatgttgtacttataattctgtacagaaatgacaatgagctgaatatatggttttacaaagtagacatccacttgcaaaatgtttggatgtaatgttaaagcgcaatgtgcaaaatttaaaataaagaatatttattaatacgcacagtaaaa

SEQ ID NO: 300954 - DNA, 2002 bp, Homo sapiens
ttattttggatgctgtagatgggagagagtgccatcatctagtacactgttatatgccacaagaaataattgcacagccatttcttaattttaaggtttttcttttcaacaggttttgcactgattgcaaaaataaagtcctccgagcatacaatatccttattggtgaacttgactgcagcaaagaaaagggctactgtgctgcactttatgaaggcttgcggtgctgtccacatgaacgacacatacatgtttgctgtgaaacagacttcattgcacatcttttgggtcgtgctgagccagagttcgcaggagggcgaagagaaaggcatgcaaagacaatagatatagctcaagaagaagttctgacctgcttgggaattcatctttatgaaagactgcatcgaatctggcagaagctacgggcagaagagcagacatggcagatgcttttctatcttggtgttgatgctttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaaggaaacagacttcatagaaaatagcagctgcaaagcctgtggcagcactgaagatggtaatacttgtgtagaagtaattgttaccaatgaaaatacatcatgtacctgtcctagcagtggcaatcttttggggtcccctaaaataaagaaaggcttatctccacactgtaatggtagtgattgtggatattcatctagcatggaagggagtgaaacaggttctcgggagggttcggatgttgcctgcactgaaggcatttgtaatcatgatgaacacggtgatgactcttgtgttcatcactgtgaagacaaagaggatgatggtgatagttgtgttgaatgttgggcaaattctgaagagaacgacacaaaaggaaaaaataaaaagaagaaaaagaaaagcaagatactgaaatgtgatgaacatatccagaagcttggaagctgtattacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgatgagtctgaatgtacttcagatgaggaaatctttatctcacaagatgaaatacagtcatttatggctaataaccagtctttctacagcaatagagaacaataccgacagcatctgaaggagaaatttaataaatactgccggttaaatgatcacaagaggcccatttgtagtggctggttgacaacggctggagcaaattaaataaataaaatagctctgtctttcaatgaaacactcacgatgactactgcgccttctctttcgaaaaactcttaatttagtgacttatggcaaaattttatcttaaatcaatgtgattctttcttgttttgggagacggtggaggtatcctcattagttctttcttcaggcttgtgtctttagttgcgtggctgcgcaggcctgccatatgatttaagccatctcttttcattaaatgtttctcttcctgtgagacttactaaagcaacttagtggcaaaaagtaatgttgtacttataattctgtacagaaatgacaatgagctgaatatatggttttacaaagtagacatccacttgcaaaatgtttggatgtaatgttaaagcgcaatgtgcaaaatttaaaataaagaatatttattaatacgcacagtaaaa

SEQ ID NO: 300955 - DNA, 2815 bp, Homo sapiens
  misc_feature (710)..(710): n is a, c, g, or t
  misc_feature (768)..(768): n is a, c, g, or t
aagtatagtgtgtgattataccctttataggcaagagaaggcatgcaaagacaatagatcatcagctcagaagaagttgtgacctgcttgggaattcatctttatgaaagactgcttcattttattactgaaagtttattttcatcaccttctgcctcagtacatatgatatatgtataaattaaagtatgcctgtaaagattttgcttctctttaaagtatgcatttcttaattgactgaaaatagggaaaaactgttctctggtgtttggttcagtcctctgctagttcttgcttgaagggaggcaggcttttttggctttcattgttacagactatcattttcatttgaaaatgattagaagggatttttctccctctatccatgcattatcatgtgtaaattttattcacaataatggtttttgcataagtcagatctttgcagtaggggattaagaaatgccttattgaatgtaattcacgaactgtgtatattatattattattactacacagaaacctaaagtagtatctctggctttgttgtaaaaataaaatcagatgatgatgttaatagaataaatcaaatgcatttccttttgtatttagggtatcaaccctcatttgagtgcctactttctgctagaatacaaagggcttttttatcgccaaagttctgtgaacacttgtaaagactggcctggtgnaggactcttgcccatgatgaatcactttggcattgcctttctcaattcctcctcaaancaaaaaacctaaagaaggaaaaaatgttttgctataattggaaagtaaaaggaactgttgtgtctactatgagctggacacttctatgtgattgctttgtgccctaaaacccatctttttagagccagttcctgaattactttatttttagcaatacgaggactaaattctacttgcatgtgtatttctcattggttgtggacatgcatgcttgtatagcaacatatacgttgagtgtaaatgtataactgtcttgttactaggtaagcacattgtgtttaaaacctgaacttgcagctgtgttatccatcttttactgtttcagttaaaggtattagtgtgtgattattcccttttataggcgaagagaaaggcatgcaaagacaatagatatagctcaagaagaagttctgacctgcttgggaattcatctttatgaaagactgcatcgaatctggcagaagctacgggcagaagagcagacatggcagatgcttttctatcttggtgttgatgctttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaaggaaacagacttcatagaaaatagcagctgcaaagcctgtggcagcactgaagatggtaatacttgtgtagaagtaattgttaccaatgaaaatacatcatgtacctgtcctagcagtggcaatcttttggggtcccctaaaataaagaaaggcttatctccacactgtaatggtagtgattgtggatattcatctagcatggaagggagtgaaacaggttctcgggagggttcggatgttgcctgcactgaaggcatttgtaatcatgatgaacacggtgatgactcttgtgttcatcactgtgaagacaaagaggatgatggtgatagttgtgttgaatgttgggcaaattctgaagagaacgacacaaaaggaaaaaataaaaagaagaaaaagaaaagcaagatactgaaatgtgatgaacatatccagaagcttggaagctgtattacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgatgagtctgaatgtacttcagatgaggaaatctttatctcacaagatgaaatacagtcatttatggctaataaccagtctttctacagcaatagagaacaataccgacagcatctgaaggagaaatttaataaatactgccggttaaatgatcacaagaggcccatttgtagtggctggttgacaacggctggagcaaattaaataaataaaatagctctgtctttcaatgaaacactcacgatgactactgcgccttctctttcgaaaaactcttaatttagtgacttatggcaaaattttatcttaaatcaatgtgattctttcttgttttgggagacggtggaggtatcctcattagttctttcttcaggcttgtgtctttagttgcgtggctgcgcaggcctgccatatgatttaagccatctcttttcattaaatgtttctcttcctgtgagacttactaaagcaacttagtggcaaaaagtaatgttgtacttataattctgtacagaaatgacaatgagctgaatatatggttttacaaagtagacatccacttgcaaaatgtttggatgtaatgttaaagcgcaatgtgcaaaatttaaaataaagaatatttattaatacgcacagtaaaa

SEQ ID NO: 300956 - DNA, 3276 bp, Homo sapiens
gcgagcggctgactgcccgtagaggaaacgacattcggagctgcgctcccgcccaggccggccctgacgcgggcctcgtcagccagtaacagggagcagaggtgggagttagcgaggcgaccacgaaaacggtgaaggtcggaaccgacagcctcctccgagaagggcaggagctgggaggaggcggcagcggcggcggcagaaacagcagcggcggcggcggcggcagctgggaggaggtggtgacggtggcaacggcagcgtcggggacgatggcgcgactcgtggcagtgtgcagggacggggaggaggagttccccttcgagaggaggcagattcccctctacatagacgacaccctgacgatggtgatggaatttcctgataatgtgttaaatctcgatggacatcagaataatggtgcacagctaaagcagttcattcagcgacatggtatgcttaagcaacaggatctaagtattgccatggtggtgacatcacgcgaagtcctgagtgcactttctcagcttgtcccatgtgttggttgtcgtcgcagtgtggagcgtctcttttcccagcttgtagagtctggaaatcctgctcttgaacccctaacagtagggcccaagggagtcctgtctgtaactagaagctgcatgactgatgcaaagaagctttatacattattttatgtacatgggtccaaactaaatgacatgatagatgctattccaaaaagtaagaagaataagagatgtcagttgcactccttagatacgcacaagccaaaacctttgggaggttgttggatggatgtatgggaactaatgtcgcaggaatgcagggatgaagtagttttaattgactcgagttgtcttttagaaacactagaaacatatctgcgaaaacacaggttttgcactgattgcaaaaataaagtcctccgagcatacaatatccttattggtgaacttgactgcagcaaagaaaagggctactgtgctgcactttatgaaggcttgcggtgctgtccacatgaacgacacatacatgtttgctgtgaaacagacttcattgcacatcttttgggtcgtgctgagccagagttcgcaggagggcgaagagaaaggcatgcaaagacaatagatatagctcaagaagaagttctgacctgcttgggaattcatctttatgaaagactgcatcgaatctggcagaagctacgggcagaagagcagacatggcagatgcttttctatcttggtgttgatgctttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaaggaaacagacttcatagaaaatagcagctgcaaagcctgtggcagcactgaagatggtaatacttgtgtagaagtaattgttaccaatgaaaatacatcatgtacctgtcctagcagtggcaatcttttggggtcccctaaaataaagaaaggtaagtaaataatttctttttaaaatgaactcttaactctattctttcttactgttaaatgtaagagcttttagagattctgtgagctagaattttaaaactgctttatagttccaagaatatcatataatttagtcagatacttaatatttcctttttctttatgttctttgacttatttttgacaaaaacgaaaaatggtaaattcctaatcatattttcattatttaatttactttctacttaaaaaaaaaatccttcattggaaatgttctacttttaataagccattaattatgagatttttctgtggtccccaaagagttcactctttgtcctaatatacttattggtatgttaatagtaactctcacttgatttattctcaggcttatctccacactgtaatggtagtgattgtggatattcatctagcatggaagggagtgaaacaggttctcgggagggttcggatgttgcctgcactgaaggcatttgtaatcatgatgaacacggtaggctcacattaagtttcccagttatttctactacatggctgacttaagaacataaataagaaggattattgatttctgcaggtgatgactcttgtgttcatcactgtgaagacaaagaggatgatggtgatagttgtgttgaatgttgggcaaattctgaagagaacgacacaaaaggaaaaaataaaaagaagaaaaagaaaagcaagatactgaaatgtgatgaacatatccagaagcttggaagctgtattacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgatgagtctgaatgtacttcagatgaggaaatctttatctcacaagatgaaatacagtcatttatggctaataaccagtctttctacagcaatagagaacaataccgacagcatctgaaggagaaatttaataaatactgccggttaaatgatcacaagaggcccatttgtagtggctggttgacaacggctggagcaaattaaataaataaaatagctctgtctttcaatgaaacactcacgatgactactgcgccttctctttcgaaaaactcttaatttagtgacttatggcaaaattttatcttaaatcaatgtgattctttcttgttttgggagacggtggaggtatcctcattagttctttcttcaggcttgtgtctttagttgcgtggctgcgcaggcctgccatatgatttaagccatctcttttcattaaatgtttctcttcctgtgagacttactaaagcaacttagtggcaaaaagtaatgttgtacttataattctgtacagaaatgacaatgagctgaatatatggttttacaaagtagacatccacttgcaaaatgtttggatgtaatgttaaagcgcaatgtgcaaaatttaaaataaagaatatttattaatacgcacagtaaaa

SEQ ID NO: 300957 - DNA, 3351 bp, Homo sapiens
gcgagcggctgactgcccgtagaggaaacgacattcggagctgcgctcccgcccaggccggccctgacgcgggcctcgtcagccagtaacagggagcagaggtgggagttagcgaggcgaccacgaaaacggtgaaggtcggaaccgacagcctcctccgagaagggcaggagctgggaggaggcggcagcggcggcggcagaaacagcagcggcggcggcggcggcagctgggaggaggtggtgacggtggcaacggcagcgtcggggacgatggcgcgactcgtggcagtgtgcagggacggggaggaggagttccccttcgagaggaggcagattcccctctacatagacgacaccctgacgatggtgatggaatttcctgataatgtgttaaatctcgatggacatcagaataatggtgcacagctaaagcagttcattcagcgacatggtatgcttaagcaacaggatctaagtattgccatggtggtgacatcacgcgaagtcctgagtgcactttctcagcttgtcccatgtgttggttgtcgtcgcagtgtggagcgtctcttttcccagcttgtagagtctggaaatcctgctcttgaacccctaacagtagggcccaagggagtcctgtctgtaactagaagctgcatgactgatgcaaagaagctttatacattattttatgtacatgggtccaaactaaatgacatgatagatgctattccaaaaagtaagaagaataagagatgtcagttgcactccttagatacgcacaagccaaaacctttgggaggttgttggatggatgtatgggaactaatgtcgcaggaatgcagggatgaagtagttttaattgactcgagttgtcttttagaaacactagaaacatatctgcgaaaacacaggttttgcactgattgcaaaaataaagtcctccgagcatacaatatccttattggtgaacttgactgcagcaaagaaaagggctactgtgctgcactttatgaaggcttgcggtgctgtccacatgaacgacacatacatgtttgctgtgaaacagacttcattgcacatcttttgggtcgtgctgagccagagttcgcaggagggcgaagagaaaggcatgcaaagacaatagatatagctcaagaagaagttctgacctgcttgggaattcatctttatgaaagactgcatcgaatctggcagaagctacgggcagaagagcagacatggcagatgcttttctatcttggtgttgatgctttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaaggaaacagacttcatagaaaatagcagctgcaaagcctgtggcagcactgaagatggtaatacttgtgtagaagtaattgttaccaatgaaaatacatcatgtacctgtcctagcagtggcaatcttttggggtcccctaaaataaagaaaggcttatctccacactgtaatggtagtgattgtggatattcatctagcatggaagggagtgaaacaggttctcgggagggttcggatgttgcctgcactgaaggcatttgtaatcatgatgaacacggtgatgactcttgtgttcatcactgtgaagacaaagaggatgatggtgatagttgtgttgaatgttgggcaaattctgaagagaacgacacaaaaggaaaaaataaaaagaagaaaaagaaaagcaagatactgaaatgtgatgaacatatccagaagcttggaagctgtattacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgatgagtctgaatgtacttcagatgaggaaatctttatctcacaagatgaaatacagtcatttatggctaataaccagtctttctacagcaatagagaacaataccgacagcatctgaaggagaaatttaataaatactgccggttaaatgatcacaagaggcccatttgtagtggctggttgacaacggctggagcaaattaaataaataaaatagctctgtctttcaatgaaacactcacgatgactactgcgccttctctttcgaaaaactcttaatttagtgacttatggcaaaattttatcttaaatcaatgtgattctttcttgttttgggagacggtggaggtatcctcattagttctttcttcaggcttgtgtctttagttgcgtggctgcgcaggcctgccatatgatttaagccatctcttttcattaaatgtttctcttcctgtgagacttactaaagcaacttagtggcaaaaagtaatgttgtacttataattctgtacagaaatgacaatgagctgaatatatggttttacaaagtagacatccacttgcaaaatgtttggatgtaatgttaaagcgcaatgtgcaaaatttaaaataaagaatatttattaatacgcacagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaagaaaagaaaaagtaaaaagaaaacaaagaacaaaaaaaaaagaaggggggggagcctgactataattacttcacctccgcgcggtgagccagtcattctgtgctccctccttttttgtttagaccgtgacggctccttcatcttagtttgtacgttaataaatagagtcgacgcccgctgccgcacgacccttactaataaaaacagtcacgagcctcactctcaaacatctagttgcgttctcgttcctctatcagaccacccccccctactctgttgtggctagtgagatgtatgcacccccaccccaccacagtatatttatgcttctgtgtgaacaatacatcatcctgctcttattgctctaccaaacccctcactttttctgctcactcaaagcatactccctcagccttttatatgatccattcacacgccccgctttctaaccaatggag

SEQ ID NO: 300958 - DNA, 2888 bp, Homo sapiens
gcgagcggctgactgcccgtagaggaaacgacattcggagctgcgctcccgcccaggccggccctgacgcgggcctcgtcagccagtaacagggagcagaggtgggagttagcgaggcgaccacgaaaacggtgaaggtcggaaccgacagcctcctccgagaagggcaggagctgggaggaggcggcagcggcggcggcagaaacagcagcggcggcggcggcggcagctgggaggaggtggtgacggtggcaacggcagcgtcggggacgatggcgcgactcgtggcagtgtgcagggacggggaggaggagttccccttcgagaggaggcagattcccctctacatagacgacaccctgacgatggtgatggaatttcctgataatgtgttaaatctcgatggacatcagaataatggtgcacagctaaagcagttcattcagcgacatggtatgcttaagcaacaggatctaagtattgccatggtggtgacatcacgcgaagtcctgagtgcactttctcagcttgtcccatgtgttggttgtcgtcgcagtgtggagcgtctcttttcccagcttgtagagtctggaaatcctgctcttgaacccctaacagtagggcccaagggagtcctgtctgtaactagaagctgcatgactgatgcaaagaagctttatacattattttatgtacatgggtccaaactaaatgacatgatagatgctattccaaaaagtaagaagaataagagatgtcagttgcactccttagatacgcacaagccaaaacctttgggaggttgttggatggatgtatgggaactaatgtcgcaggaatgcagggatgaagtagttttaattgactcgagttgtcttttagaaacactagaaacatatctgcgaaaacacaggttttgcactgattgcaaaaataaagtcctccgagcatacaatatccttattggtgaacttgactgcagcaaagaaaagggctactgtgctgcactttatgaaggcttgcggtgctgtccacatgaacgacacatacatgtttgctgtgaaacagacttcattgcacatcttttgggtcgtgctgagccagagttcgcaggagggcgaagagaaaggcatgcaaagacaatagatatagctcaagaagaagttctgacctgcttgggaattcatctttatgaaagactgcatcgaatctggcagaagctacgggcagaagagcagacatggcagatgcttttctatcttggtgttgatgctttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaagcttcctcagagacattcataagtgaaatatctttttgtgagagcgcttgacagttgaagaatacagtgattcttagcacactttggaaacagacttcatagaaaatagcagctgcaaagcctgtggcagcactgaagatggtaatacttgtgtagaagtaattgttaccaatgaaaatacatcatgtacctgtcctagcagtggcaatcttttggggtcccctaaaataaagaaaggcttatctccacactgtaatggtagtgattgtggatattcatctagcatggaagggagtgaaacaggttctcgggagggttcggatgttgcctgcactgaaggcatttgtaatcatgatgaacacggtgatgactcttgtgttcatcactgtgaagacaaagaggatgatggtgatagttgtgttgaatgttgggcaaattctgaagagaacgacacaaaaggaaaaaataaaaagaagaaaaagaaaagcaagatactgaaatgtgatgaacatatccagaagcttggaagctgtattacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgatgagtctgaatgtacttcagatgaggaaatctttatctcacaagatgaaatacagtcatttatggctaataaccagtctttctacagcaatagagaacaataccgacagcatctgaaggagaaatttaataaatactgccggttaaatgatcacaagaggcccatttgtagtggctggttgacaacggctggagcaaattaaataaataaaatagctctgtctttcaatgaaacactcacgatgactactgcgccttctctttcgaaaaactcttaatttagtgacttatggcaaaattttatcttaaatcaatgtgattctttcttgttttgggagacggtggaggtatcctcattagttctttcttcaggcttgtgtctttagttgcgtggctgcgcaggcctgccatatgatttaagccatctcttttcattaaatgtttctcttcctgtgagacttactaaagcaacttagtggcaaaaagtaatgttgtacttataattctgtacagaaatgacaatgagctgaatatatggttttacaaagtagacatccacttgcaaaatgtttggatgtaatgttaaagcgcaatgtgcaaaatttaaaataaagaatatttattaatacgcacagtaaaa

SEQ ID NO: 300959 - DNA, 1429 bp, Homo sapiens
tactcgatatcctcttctgaaaattcctcacaaagttgttccaatctgctaataccctgtactttttccacggtcatctcaaaactcttgcgtaaacatcaataccaagataggaaacagacttcatagaaaatagcagctgcaaagcctgtggcagcactgaagatggtaatacttgtgtagaagtaattgttaccaatgaaaatacatcatgtacctgtcctagcagtggcaatcttttggggtcccctaaaataaagaaaggcttatctccacactgtaatggtagtgattgtggatattcatctagcatggaagggagtgaaacaggttctcgggagggttcggatgttgcctgcactgaaggcatttgtaatcatgatgaacacggtgatgactcttgtgttcatcactgtgaagacaaagaggatgatggtgatagttgtgttgaatgttgggcaaattctgaagagaacgacacaaaaggaaaaaataaaaagaagaaaaagaaaagcaagatactgaaatgtgatgaacatatccagaagcttggaagctgtattacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgatgagtctgaatgtacttcagatgaggaaatctttatctcacaagatgaaatacagtcatttatggctaataaccagtctttctacagcaatagagaacaataccgacagcatctgaaggagaaatttaataaatactgccggttaaatgatcacaagaggcccatttgtagtggctggttgacaacggctggagcaaattaaataaataaaatagctctgtctttcaatgaaacactcacgatgactactgcgccttctctttcgaaaaactcttaatttagtgacttatggcaaaattttatcttaaatcaatgtgattctttcttgttttgggagacggtggaggtatcctcattagttctttcttcaggcttgtgtctttagttgcgtggctgcgcaggcctgccatatgatttaagccatctcttttcattaaatgtttctcttcctgtgagacttactaaagcaacttagtggcaaaaagtaatgttgtacttataattctgtacagaaatgacaatgagctgaatatatggttttacaaagtagacatccacttgcaaaatgtttggatgtaatgttaaagcgcaatgtgcaaaatttaaaataaagaatatttattaatacgcacagtaaaa

SEQ ID NO: 300960 - DNA, 2868 bp, Homo sapiens
gcgagcggctgactgcccgtagaggaaacgacattcggagctgcgctcccgcccaggccggccctgacgcgggcctcgtcagccagtaacagggagcagaggtgggagttagcgaggcgaccacgaaaacggtgaaggtcggaaccgacagcctcctccgagaagggcaggagctgggaggaggcggcagcggcggcggcagaaacagcagcggcggcggcggcggcagctgggaggaggtggtgacggtggcaacggcagcgtcggggacgatggcgcgactcgtggcagtgtgcagggacggggaggaggagttccccttcgagaggaggcagattcccctctacatagacgacaccctgacgatggtgatggaatttcctgataatgtgttaaatctcgatggacatcagaataatggtgcacagctaaagcagttcattcagcgacatggtatgcttaagcaacaggatctaagtattgccatggtggtgacatcacgcgaagtcctgagtgcactttctcagcttgtcccatgtgttggttgtcgtcgcagtgtggagcgtctcttttcccagcttgtagagtctggaaatcctgctcttgaacccctaacagtagggcccaagggagtcctgtctgtaactagaagctgcatgactgatgcaaagaagctttatacattattttatgtacatgggtccaaactaaatgacatgatagatgctattccaaaaagtaagaagaataagagatgtcagttgcactccttagatacgcacaagccaaaacctttgggaggttgttggatggatgtatgggaactaatgtcgcaggaatgcagggatgaagtagttttaattgactcgagttgtcttttagaaacactagaaacatatctgcgaaaacacaggttttgcactgattgcaaaaataaagtcctccgagcatacaatatccttattggtgaacttgactgcagcaaagaaaagggctactgtgctgcactttatgaaggcttgcggtgctgtccacatgaacgacacatacatgtttgctgtgaaacagacttcattgcacatcttttgggtcgtgctgagccagagttcgcaggagggcgaagagaaaggcatgcaaagacaatagatatagctcaagaagaagttctgacctgcttgggaattcatctttatgaaagactgcatcgaatctggcagaagctacgggcagaagagcagacatggcagatgcttttctatcttggtgttgatgctttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaaggaaacagacttcatagaaaatagcagctgcaaagcctgtggcagcactgaagatggtaatacttgtgtagaagtaattgttaccaatgaaaatacatcatgtacctgtcctagcagtggcaatcttttggggtcccctaaaataaagaaaggtaagtaaataatttctttttaaaatgaactcttaactctattctttcttactgttaaatgtaagagcttttagagattctgtgagctagaattttaaaactgctttatagttccaagaatatcatataatttagtcagatacttaatatttcctttttctttatgttctttgacttatttttgacaaaaacgaaaaatggtaaattcctaatcatattttcattatttaatttactttctacttaaaaaaaaaatccttcattggaaatgttctacttttaataagccattaattatgagatttttctgtggtccccaaagagttcactctttgtcctaatatacttattggtatgttaatagtaactctcacttgatttattctcaggcttatctccacactgtaatggtagtgattgtggatattcatctagcatggaagggagtgaaacaggttctcgggagggttcggatgttgcctgcactgaaggcatttgtaatcatgatgaacacggtaggctcacattaagtttcccagttatttctactacatggctgacttaagaacataaataagaaggattattgatttctgcaggtgatgactcttgtgttcatcactgtgaagacaaagaggatgatggtgatagttgtgttgaatgttgggcaaattctgaagagaacgacacaaaaggaaaaaataaaaagaagaaaaagaaaagcaagatactgaaatgtgatgaacatatccagaagcttggaagctgtattacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgatgagtctgaatgtacttcagatgaggaaatctttatctcacaagatgaaatacagtcatttatggctaataaccagtctttctacagcaatagagaacaataccgacagcatctgaaggagaaatttaataaatactgccggttaaatgatcacaagaggcccatttgtagtggctggttgacaacggctggagcaaattaaataaataaaatagctctgtctttcaatga

SEQ ID NO: 300961 - DNA, 2850 bp, Homo sapiens
gcgagcggctgactgcccgtagaggaaacgacattcggagctgcgctcccgcccaggccggccctgacgcgggcctcgtcagccagtaacagggagcagaggtgggagttagcgaggcgaccacgaaaacggtgaaggtcggaaccgacagcctcctccgagaagggcaggagctgggaggaggcggcagcggcggcggcagaaacagcagcggcggcggcggcggcagctgggaggaggtggtgacggtggcaacggcagcgtcggggacgatggcgcgactcgtggcagtgtgcagggacggggaggaggagttccccttcgagaggaggcagattcccctctacatagacgacaccctgacgatggtgatggaatttcctgataatgtgttaaatctcgatggacatcagaataatggtgcacagctaaagcagttcattcagcgacatggtatgcttaagcaacaggatctaagtattgccatggtggtgacatcacgcgaagtcctgagtgcactttctcagcttgtcccatgtgttggttgtcgtcgcagtgtggagcgtctcttttcccagcttgtagagtctggaaatcctgctcttgaacccctaacagtagggcccaagggagtcctgtctgtaactagaagctgcatgactgatgcaaagaagctttatacattattttatgtacatgggtccaaactaaatgacatgatagatgctattccaaaaagtaagaagaataagagatgtcagttgcactccttagatacgcacaagccaaaacctttgggaggttgttggatggatgtatgggaactaatgtcgcaggaatgcagggatgaagtagttttaattgactcgagttgtcttttagaaacactagaaacatatctgcgaaaacacaggttttgcactgattgcaaaaataaagtcctccgagcatacaatatccttattggtgaacttgactgcagcaaagaaaagggctactgtgctgcactttatgaaggcttgcggtgctgtccacatgaacgacacatacatgtttgctgtgaaacagacttcattgcacatcttttgggtcgtgctgagccagagttcgcaggagggcgaagagaaaggcatgcaaagacaatagatatagctcaagaagaagttctgacctgcttgggaattcatctttatgaaagactgcatcgaatctggcagaagctacgggcagaagagcagacatggcagatgcttttctatcttggtgttgatgctttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaaggaaacagacttcatagaaaatagcagctgcaaagcctgtggcagcactgaagatggtaatacttgtgtagaagtaattgttaccaatgaaaatacatcatgtacctgtcctagcagtggcaatcttttggggtcccctaaaataaagaaaggtaagtaaataatttctttttaaaatgaactcttaactctattctttcttactgttaaatgtaagagcttttagagattctgtgagctagaattttaaaactgctttatagttccaagaatatcatataatttagtcagatacttaatatttcctttttctttatgttctttgacttatttttgacaaaaacgaaaaatggtaaattcctaatcatattttcattatttaatttactttctacttaaaaaaaaaatccttcattggaaatgttctacttttaataagccattaattatgagatttttctgtggtccccaaagagttcactctttgtcctaatatacttattggtatgttaatagtaactctcacttgatttattctcaggcttatctccacactgtaatggtagtgattgtggatattcatctagcatggaagggagtgaaacaggttctcgggagggttcggatgttgcctgcactgaaggcatttgtaatcatgatgaacacggtaggctcacattaagtttcccagttatttctactacatggctgacttaagaacataaataagaaggattattgatttctgcaggtgatgactcttgtgttcatcactgtgaagacaaagaggatgatggtgatagttgtgttgaatgttgggcaaattctgaagagaacgacacaaaaggaaaaaataaaaagaagaaaaagaaaagcaagatactgaaatgtgatgaacatatccagaagcttggaagctgtattacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgatgagtctgaatgtacttcagatgaggaaatctttatctcacaagatgaaatacagtcatttatggctaataaccagtctttctacagcaatagagaacaataccgacagcatctgaaggagaaatttaataaatactgccggttaaatgatcacaaaagttcatatgtgtggaacctggttgggtgcatcgataacaccggtaccgagctcca

SEQ ID NO: 300962 - DNA, 2327 bp, Homo sapiens
gcgagcggctgactgcccgtagaggaaacgacattcggagctgcgctcccgcccaggccggccctgacgcgggcctcgtcagccagtaacagggagcagaggtgggagttagcgaggcgaccacgaaaacggtgaaggtcggaaccgacagcctcctccgagaagggcaggagctgggaggaggcggcagcggcggcggcagaaacagcagcggcggcggcggcggcagctgggaggaggtggtgacggtggcaacggcagcgtcggggacgatggcgcgactcgtggcagtgtgcagggacggggaggaggagttccccttcgagaggaggcagattcccctctacatagacgacaccctgacgatggtgatggaatttcctgataatgtgttaaatctcgatggacatcagaataatggtgcacagctaaagcagttcattcagcgacatggtatgcttaagcaacaggatctaagtattgccatggtggtgacatcacgcgaagtcctgagtgcactttctcagcttgtcccatgtgttggttgtcgtcgcagtgtggagcgtctcttttcccagcttgtagagtctggaaatcctgctcttgaacccctaacagtagggcccaagggagtcctgtctgtaactagaagctgcatgactgatgcaaagaagctttatacattattttatgtacatgggtccaaactaaatgacatgatagatgctattccaaaaagtaagaagaataagagatgtcagttgcactccttagatacgcacaagccaaaacctttgggaggttgttggatggatgtatgggaactaatgtcgcaggaatgcagggatgaagtagttttaattgactcgagttgtcttttagaaacactagaaacatatctgcgaaaacacaggttttgcactgattgcaaaaataaagtcctccgagcatacaatatccttattggtgaacttgactgcagcaaagaaaagggctactgtgctgcactttatgaaggcttgcggtgctgtccacatgaacgacacatacatgtttgctgtgaaacagacttcattgcacatcttttgggtcgtgctgagccagagttcgcaggagggcgaagagaaaggcatgcaaagacaatagatatagctcaagaagaagttctgacctgcttgggaattcatctttatgaaagactgcatcgaatctggcagaagctacgggcagaagagcagacatggcagatgcttttctatcttggtgttgatgctttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaaggaaacagacttcatagaaaatagcagctgcaaagcctgtggcagcactgaagatggtaatacttgtgtagaagtaattgttaccaatgaaaatacatcatgtacctgtcctagcagtggcaatcttttggggtcccctaaaataaagaaaggcttatctccacactgtaatggtagtgattgtggatattcatctagcatggaagggagtgaaacaggttctcgggagggttcggatgttgcctgcactgaaggcatttgtaatcatgatgaacacggtgatgactcttgtgttcatcactgtgaagacaaagaggatgatggtgatagttgtgttgaatgttgggcaaattctgaagagaacgacacaaaaggaaaaaataaaaagaagaaaaagaaaagcaagatactgaaatgtgatgaacatatccagaagcttggaagctgtattacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgatgagtctgaatgtacttcagatgaggaaatctttatctcacaagatgaaatacagtcatttatggctaataaccagtctttctacagcaatagagaacaataccgacagcatctgaaggagaaatttaacgcgtcaaatcgggatccctaagtcgactgcagc

SEQ ID NO: 300963 - DNA, 951 bp, Homo sapiens
aaagaataattgctattatatcatgcctttttacctgtgaaatcctttgctgtggtatcagatccagaagcttggaagctgtattacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgatgagtctgaatgtacttcagatgaggaaatctttatctcacaagatgaaatacagtcatttatggctaataaccagtctttctacagcaatagagaacaataccgacagcatctgaaggagaaatttaataaatactgccggttaaatgatcacaagaggcccatttgtagtggctggttgacaacggctggagcaaattaaataaataaaatagctctgtctttcaatgaaacactcacgatgactactgcgccttctctttcgaaaaactcttaatttagtgacttatggcaaaattttatcttaaatcaatgtgattctttcttgttttgggagacggtggaggtatcctcattagttctttcttcaggcttgtgtctttagttgcgtggctgcgcaggcctgccatatgatttaagccatctcttttcattaaatgtttctcttcctgtgagacttactaaagcaacttagtggcaaaaagtaatgttgtacttataattctgtacagaaatgacaatgagctgaatatatggttttacaaagtagacatccacttgcaaaatgtttggatgtaatgttaaagcgcaatgtgcaaaatttaaaataaagaatatttattaatacgcacagtaaaa

SEQ ID NO: 300964 - DNA, 2985 bp, Homo sapiens
gcgagcggctgactgcccgtagaggaaacgacattcggagctgcgctcccgcccaggccggccctgacgcgggcctcgtcagccagtaacagggagcagaggtgggagttagcgaggcgaccacgaaaacggtgaaggtcggaaccgacagcctcctccgagaagggcaggagctgggaggaggcggcagcggcggcggcagaaacagcagcggcggcggcggcggcagctgggaggaggtggtgacggtggcaacggcagcgtcggggacgatggcgcgactcgtggcagtgtgcagggacggggaggaggagttccccttcgagaggaggcagattcccctctacatagacgacaccctgacgatggtgatggaatttcctgataatgtgttaaatctcgatggacatcagaataatggtgcacagctaaagcagttcattcagcgacatggtatgcttaagcaacaggatctaagtattgccatggtggtgacatcacgcgaagtcctgagtgcactttctcagcttgtcccatgtgttggttgtcgtcgcagtgtggagcgtctcttttcccagcttgtagagtctggaaatcctgctcttgaacccctaacagtagggcccaagggagtcctgtctgtaactagaagctgcatgactgatgcaaagaagctttatacattattttatgtacatgggtccaaactaaatgacatgatagatgctattccaaaaagtaagaagaataagagatgtcagttgcactccttagatacgcacaagccaaaacctttgggaggttgttggatggatgtatgggaactaatgtcgcaggaatgcagggatgaagtagttttaattgactcgagttgtcttttagaaacactagaaacatatctgcgaaaacacaggttttgcactgattgcaaaaataaagtcctccgagcatacaatatccttattggtgaacttgactgcagcaaagaaaagggctactgtgctgcactttatgaaggcttgcggtgctgtccacatgaacgacacatacatgtttgctgtgaaacagacttcattgcacatcttttgggtcgtgctgagccagagttcgcaggagggcgaagagaaaggcatgcaaagacaatagatatagctcaagaagaagttctgacctgcttgggaattcatctttatgaaagactgcatcgaatctggcagaagctacgggcagaagagcagacatggcagatgcttttctatcttggtgttgatgctttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaaggaaacagacttcatagaaaatagcagctgcaaagcctgtggcagcactgaagatggtaatacttgtgtagaagtaattgttaccaatgaaaatacatcatgtacctgtcctagcagtggcaatcttttggggtcccctaaaataaagaaaggtaagtaaataatttctttttaaaatgaactcttaactctattctttcttactgttaaatgtaagagcttttagagattctgtgagctagaattttaaaactgctttatagttccaagaatatcatataatttagtcagatacttaatatttcctttttctttatgttctttgacttatttttgacaaaaacgaaaaatggtaaattcctaatcatattttcattatttaatttactttctacttaaaaaaaaaatccttcattggaaatgttctacttttaataagccattaattatgagatttttctgtggtccccaaagagttcactctttgtcctaatatacttattggtatgttaatagtaactctcacttgatttattctcaggcttatctccacactgtaatggtagtgattgtggatattcatctagcatggaagggagtgaaacaggttctcgggagggttcggatgttgcctgcactgaaggcatttgtaatcatgatgaacacggtaggctcacattaagtttcccagttatttctactacatggctgacttaagaacataaataagaaggattattgatttctgcaggtgatgactcttgtgttcatcactgtgaagacaaagaggatgatggtgatagttgtgttgaatgttgggcaaattctgaagagaacgacacaaaaggaaaaaataaaaagaagaaaaagaaaagcaagatactgaaatgtgatgaacatatccagaagcttggaagctgtattacagatccaggtaatcgagagacctcaggaaataccatgcacacagtgtttcaccgtgacaagaccaaagatacacatcctgaaagctgttgcagctctgaaaagggtgggcagccattgccttggtttgagcataggaaaaatgtaccacagtttgcagaacctacagaaacgttgtttggtcccgattccggaaaaggtgccaagagcttagttgaactccttgtaagtattccatgtggtcttactgtacataactgtttgggaacggggtggatgtgggaggggatagtatttgagggcttaaggtaggtagttgaaggaagcttatgagaaattaagggtagtatttcattattgtttggggacttcatttctgtccttccactcgtggtttatgcaactactctggaacacgtttccatggccgcctctgtctcagtagaagacattataggtattccttgagttacagtggggttacattccaataaacccattataactcaaaaatactgcgagttgaaaatacattcaacatcccaataaaccctttgtaaagttaaaaaaaaaaa

SEQ ID NO: 300965 - DNA, 1369 bp, Homo sapiens
gcgagcggctgactgcccgtagaggaaacgacattcggagctgcgctcccgcccaggccggccctgacgcgggcctcgtcagccagtaacagggagcagaggtgggagttagcgaggcgaccacgaaaacggtgaaggtcggaaccgacagcctcctccgagaagggcaggagctgggaggaggcggcagcggcggcggcagaaacagcagcggcggcggcggcggcagctgggaggaggtggtgacggtggcaacggcagcgtcggggacgatggcgcgactcgtggcagtgtgcagggacggggaggaggagttccccttcgagaggaggcagattcccctctacatagacgacaccctgacgatggtgatggaatttcctgataatgtgttaaatctcgatggacatcagaataatggtgcacagctaaagcagttcattcagcgacatggtatgcttaagcaacaggatctaagtattgccatggtggtgacatcacgcgaagtcctgagtgcactttctcagcttgtcccatgtgttggttgtcgtcgcagtgtggagcgtctcttttcccagcttgtagagtctggaaatcctgctcttgaacccctaacagtagggcccaagggagtcctgtctgtaactagaagctgcatgactgatgcaaagaagctttatacattattttatgtacatgggtaagtataatcaattaggagaaaatgggtttgttaaaatttaaaacagcttggtgacagtggcagcttattttcttgatggaaagattgagtctgatttaataattttattgagtaagttgtatgtaccagtggatgtaaagtttcaactctccacgtggggagaggcagacagaaagcaaatattcaatttgtcagggatgataagttagaaaaatcagtaagggaggtagagaatggagtgggggtagaattattgtggaggatggtcagggaaggcctccctgataaaatgacattgaatatagatttgaatgaagtgagcaagcaaatcttgtagaaaactggggggaaggcagagaagggacagctagtgtaaaggttctgaggttggggttttattggcatgtttgaggaatagtaaggaagcccttgtggctggagccagatgaatgaagggaacagtaataaaagatggggtcagcagagtaataaggccgggcgcggtggctcacgcctgtaatcccagcactttgggaggccaaggcaggcagatcatgaggtctggaggtcgagaccatcctgaccaacgtggtgaaaccccatctctactaaaaatacaaaaattagctgagcatggtggcgcatggctgtcatcacagctattca

SEQ ID NO: 300966 - DNA, 112 bp, Homo sapiens
cttggtgttgatgctttacgcaagagttttgaggtaagaacagtgggctgttccagtatctcagattgcttagtcacgttattggactgaatcttaatgtaagccaccagtg

SEQ ID NO: 300967 - DNA, 433 bp, Homo sapiens
gaggctgttagagaatgtcatagcatcaagctccagagaaaatggtacagagtagacatgcaataaatgtttgtggaaggaaaattgatggttgagagtggtgtcaattcggaggcctgcaaagcatggatgtgttttgtgttaatctggacttttggaagcatttagtcagattcatttgcatatgagttataattcattttttggttcttttctggcattgtggtgttcattgttaagattttcccccctacacgtcacccactgactatgtgattaatttttcttctttcttttttttttttcctctgaacttgggaaacctcagctcttggcttttccttatttttccaacaccccctgtacacacatacacacacacacacaccccttttgtatatttttttgagacggagtctcgcactgtcacctg

SEQ ID NO: 300968 - DNA, 1574 bp, Homo sapiens
gatgactgtgtactttttgataggcacttgataagtagaatgaggcctgaaaatgaatacattatatttttagttaatttccaatggaaagggctaacctcagcctgtctccatatcaggtacctatcaactggattgttttcatttttgttttttgacctctttgtaattgcatgtacttctctatgtaattttcctcttgatctctactatcgtttgcttgtgtttctagtccttaaagttcataaatttaaaaaggagatttcaggatggcctttatggacgttgtctggacatacatcctcactttcttccgcagtttaccctggttttcctcagacagaggctagcgcagccccccggagtccttgttctccttaagagggtctcgctctgcaaagcatggcgccatggcttttcctttgcatgggtgtgcataccgagagacaggcagcttaggaaaaacaacataaggaagacttaaaaggatgcactgatttacgacgttttttgatgttagccatttttttggaaattgttttttaaagcaaaagttttttaaaaacatggtttatagtttttcacttacatatactattgtaaatacttagcagagtcttaagttactgtataaaacatttcattgtgtttgaagacatacttatgggtcttgaggtctgggtcctaatacttttaaatagtgtatttattatgtaaactgaggagtgccatttaaagtgtgaggattgcctgaaaaggttttgtttctttcttttttttttttttttgagatggagtcttactctgtcgcccaggctggagtgcagtggcgcaatctcggctcactgcaaccaccgcctcccgagttcaagtgattctcctgcctcagcctcctgagtaactgggactacaggcgcacgccaccatgcccagctaatttttgtattttcagtagagatggggtttcaccgtgttgaccaggatggtctccacctcctgacctcgtgatccgcctgcctcggcctcccaaagtgctgggattacaggcatgagccactgcacccggccaggttttgtttctttaaggattagcacaaatggcaccgttgggtttttcttcatacaatttccaaaataaattctgtactcaggttgttatatgattttctgagctgaataagttcaggagcagattattaagatctgccattctgaaacgctggtctttttctccttcctatagtgcaccataaaattctgtttgatcagattatattacatacattttgggggagtggagggacatgagttaagtagcccttcatgtatttataatctcttttctactgaatcaaatgacttagccatgaccctgaatggaccttgttttacttcaagttgagatgtctgccttttatgaatttgtatatgtgaatagagtttgggggttgccaaaaattgcatacattgtatgtaagtaaaattttttatgaagtagtctgtcaaattgtatcataaagtttatttttcttttatacgtaaatcattaaaaataatcacatattttttccata

SEQ ID NO: 300969 - DNA, 1441 bp, Homo sapiens
gatgactgtgtactttttgataggcacttgataagtagaatgaggcctgaaaatgaatacattatatttttagttaatttccaatggaaagggctaacctcagcctgtctccatatcaggtacctatcaactggattgttttcatttttgttttttgacctctttgtaattgcatgtacttctctatgtaattttcctcttgatctctactatcgtttgcttgtgtttctagtccttaaagttcataaatttaaaaaggagatttcaggatggcctttatggacgttgtctggacatacatcctcactttcttccgcagtttaccctggttttcctcagacagaggctagcgcagccccccggagtccttgttctccttaagagggtctcgctctgcaaagcatggcgccatggcttttcctttgcatgggtgtgcataccgagagacaggcagcttaggaaaaacaacataaggaagacttaaaaggatgcactgatttacgacgttttttgatgttagccatttttttggaaattgttttttaaagcaaaagttttttaaaaacatggtttatagtttttcacttacatatactattgtaaatacttagcagagtcttaagttactgtataaaacatttcattgtgtttgaagacatacttatgggtcttgaggtctgggtcctaatacttttaaatagtgtatttattatgtaaactgaggagtgccatttaaagtgtgaggattgcctgaaaaggttttgtttctttcttttttttttttttttgagatggagtcttactctgtcgcccaggctggagtgcagtggcgcaatctcggctcactgcaaccaccgcctcccgagttcaagtgattctcctgcctcagcctcccaaagtgctgggattacaggcatgagccactgcacccggccaggttttgtttctttaaggattagcacaaatggcaccgttgggtttttcttcatacaatttccaaaataaattctgtactcaggttgttatatgattttctgagctgaataagttcaggagcagattattaagatctgccattctgaaacgctggtctttttctccttcctatagtgcaccataaaattctgtttgatcagattatattacatacattttgggggagtggagggacatgagttaagtagcccttcatgtatttataatctcttttctactgaatcaaatgacttagccatgaccctgaatggaccttgttttacttcaagttgagatgtctgccttttatgaatttgtatatgtgaatagagtttgggggttgccaaaaattgcatacattgtatgtaagtaaaattttttatgaagtagtctgtcaaattgtatcataaagtttatttttcttttatacgtaaatcattaaaaataatcacatattttttccata

SEQ ID NO: 300970 - DNA, 1699 bp, Homo sapiens
gatgactgtgtactttttgataggcacttgataagtagaatgaggcctgaaaatgaatacattatatttttagttaatttccaatggaaagggctaacctcagcctgtctccatatcaggtacctatcaactggattgttttcatttttgttttttgacctctttgtaattgcatgtacttctctatgtaattttcctcttgatctctactatcgtttgcttgtgtttctagtccttaaagttcataaatttaaaaaggagatttcaggatggcctttatggacgttgtctggacatacatcctcactttcttccgcagtttaccctggttttcctcagacagaggctagcgcagccccccggagtccttgttctccttaagagggtctcgctctgcaaagcatggcgccatggcttttcctttgcatgggtgtgcataccgagagacaggcagcttaggaaaaacaacataaggaagacttaaaaggatgcactgatttacgacgttttttgatgttagccatttttttggaaattgttttttaaagcaaaagttttttaaaaacatggtttatagtttttcacttacatatactattgtaaatacttagcagagtcttaagttactgtataaaacatttcattgtgtttgaagacatacttatgggtcttgaggtctgggtcctaatacttttaaatagtgtatttattatgtaaactgaggagtgccatttaaagtgtgaggattgcctgaaaaggttttgtttctttcttttttttttttttttgagatggagtcttactctgtcgcccaggctggagtgcagtggcgcaatctcggctcactgcaaccaccgcctcccgagttcaagtgattctcctgcctcagcctcctgagtaactgggactacaggcgcacgccaccatgcccagctaatttttgtattttcagtagagatggggtttcaccgtgttgaccaggatggtctccacctcctgacctcgtgatccgcctgcctcggcctcccaaagtgctgggattacaggcatgagccactgcacccggccaggttttgtttctttaaggattagcacaaatggcaccgttgggtttttcttcatacaatttccaaaataaattctgtactcaggttgttatatgattttctgagctgaataagttcaggagcagattattaagatctgccattctgaaacgctggtctttttctccttcctatagtgcaccataaaattctgtttgatcagattatattacatacattttgggggagtggagggacatgagttaagtagcccttcatgtatttataatctcttttctactgaatcaaatgacttagccatgaccctgaatggaccttgttttacttcaagttgagatgtctgccttttatgaatttgtatatgtgaatagagtttgggggttgccaaaaattgcatacattgtatgtaagtaaaattttttatgaagtagtctgtcaaattgtatcataaagtttatttttcttttatacgtaaatcattaaaaataatcacatattttttccataagtgtatggattgtgcagttcgattcacacatggaaaaatcataagcatttggattttttattttcaaatgtgtgtgttttgtttttctcgtgaggaaagttcagggaaatacatcttttcattc

SEQ ID NO: 300971 - DNA, 1213 bp, Homo sapiens
  misc_feature (1182)..(1182): n is a, c, g, or t
  misc_feature (1202)..(1202): n is a, c, g, or t
gatgactgtgtactttttgataggcacttgataagtagaatgaggcctgaaaatgaatacattatatttttagttaatttccaatggaaagggctaacctcagcctgtctccatatcaggtacctatcaactggattgttttcatttttgttttttgacctctttgtaattgcatgtacttctctatgtaattttcctcttgatctctactatcgtttgcttgtgtttctagtccttaaagttcataaatttaaaaaggagatttcaggatggcctttatggacgttgtctggacatacatcctcactttcttccgcagtttaccctggttttcctcagacagaggctagcgcagccccccggagtccttgttctccttaagagggtctcgctctgcaaagcatggcgccatggcttttcctttgcatgggtgtgcataccgagagacaggcagcttaggaaaaacaacataaggaagacttaaaaggatgcactgatttacgacgttttttgatgttagccatttttttggaaattgttttttaaagcaaaagttttttaaaaacatggtttatagtttttcacttacatatactattgtaaatacttagcagagtcttaagttactgtataaaacatttcattgtgtttgaagacatacttatgggtcttgaggtctgggtcctaatacttttaaatagtgtatttattatgtaaactgaggagtgccatttaaagtgtgaggattgcctgaaaaggttttgtttctttcttttttttttttttttgagatggagtcttactctgtcgcccaggctggagtgcagtggcgcaatctcggctcactgcaaccaccgcctcccgagttcaagtgattctcctgcctcagcctcccaaagtgctgggattacaggcatgagccactgcacccggccaggttttgtttctttaaggattagcacaaatggcaccgttgggtttttcttcatacaatttccaaaataaattctgtactcaggttgttatatgattttctgagctgaataagttcaggagcagattattaagatctgccattctgaaacgctggtctccaactgctgatgagctcaggtgatccgcccacctcggcctcccaaagtgctgagattacaggcgtgacaccggcgcccggtcccttanttttttctagatggagcacnacctccattgg

SEQ ID NO: 300972 - DNA, 623 bp, Homo sapiens
atgaagcacccagaggaccacaatcctcggattttatgagaagaccttctgccctgcctgcccttttgagacctttatctgaaaaggaacctgcaatcctagaaaagaggtggaggcaggcttgattcagttaaggaagttctttcttctcagcaattaccacgccaattctgtggaaaagcaacatttggaagacgagagaaatccactgtaggaagtattagaaatacctgcaattaggcttcaaacaagcaaatgagggcaggaaaagtaaatgacgacagcctgtgtcctctccatgacaccactctgcctccatggaaccactctgcccccatggatctctccagttttaagtctggggaaatctatcaatcacacaatttcagttagcattccaagaactaggggaaggcccgagtaatctattcaaagacatgcttcagaaagaacacaccgaccccatggagagttaaacctgattaccaagaagcaggatagttaggtgtttccgctatttacataatcattgtaaatataagttacagactaattacaatgataattatgacaatgagcctggcatggaggaagagtttaataaataatatttgatgaatgaa

SEQ ID NO: 300973 - DNA, 633 bp, Homo sapiens
atgaagcacccagaggaccacaatcctcggattttatgagaagaccttctgccctgcctgcccttttgagacctttatctgaaaaggaacctgcaatcctagaaaagaggtggaggcaggcttgattcagttaaggaagttctttcttctcagcaattaccacgccaattctgtggaaaagcaacatttggaagacgagagaaatccactgtaggaagtattagaaatacctgcaattaggcttcaaacaagcaaatgagatgtatacattcatgaaaatcaacccatctacactcaactgaaaaacagatgcttcaactggagaaaaagggattttatctctccatacccaaagctatcttaaattaggacttttaacctgttgccttcgtgcgcatgtgcagtagctggattaacaggagagaaagcaacagcccaagaaccgaccctcctgcatcaaatgagtaaaccaaaaaggaaaggggatttacgcaaacaccacaatgcctccccgggagccgttccagtccatcagaaccaaatccaccctttcagcggcgtggaaatgtacggataccgaacagaccttgcatttacaataaataaacattacgtacattttccaaaatgagc

SEQ ID NO: 300974 - DNA, 938 bp, Homo sapiens
gctccccaccatctgtagccctgaaaggtctcgatccacctgctctctggacggaactgtggcttgaagagccattcctgaggactttggggcctttctctttctagacacccattttcttaattagaaagggaaaagactgtggccttgggagagttaagaatagtaagacaaggagctgggcaatccagtagtcaactagctacatgtagctatttaaattagttacaatgaaataaaattagaaaactgtagagctgcagtcgcaccagcctcattcatagccatgtgtgactggtggctgccgtcttgggtggtgccttcattgtcccagaaagttctgttggagcaagcccagctggaggaacccagcttccctggcacgcctgagggtgacatggtgccctcactgccttctgtctgtcctcactttctcctgccctgtccctccgccctcaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaagggaggcccgcggcggtggagccgagcggggagccaggaaagaagagttggagtgagatgaaggaaggactatgacaaataaaaaaggaaaaggaattcaaaaacagaaggaaaaggaaacctggtagctttttggccttggattctctctgggctccagatgacctggatgccaagccactgcccctcctctgggggcctccaccctcctctcccggctggaggtttgcctgattttctgggatggg

SEQ ID NO: 300975 - DNA, 2538 bp, Homo sapiens
ctcgcagcagagaggagttgagggcgatgagagcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcgcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggaaagaggcaaagaggggcctgggaccccgactcgaagcagcgtcatcaccagtgctagggagctacactatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaagggaggcccgcggcggtggagccgagcggggagccaggaaagaagagttggagtgagatgaaggaaggactatgacaaataaaaaaggaaaaggaattcaaaaacagaaggaaaaggaaacctggtagctttttggccttggattctctctgggctccagatgacctggatgccaagccactgcccctcctctgggggcctccaccctcctctcccggctggaggtttgcctgattttctgggatggg

SEQ ID NO: 300976 - DNA, 2446 bp, Homo sapiens
ggtctgcagcgctgcgggccctcctcggctctcggcgggaccggcggtgacaccggagctcgccgtgcgctcccggccgctctcgcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggaaagaggcaaagaggggcctgggaccccgactcgaagcagcgtcatcaccagtgctagggagctacactatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaagggaggcccgcggcggtggagccgagcggggagccaggaaagaagagttggagtgagatgaaggaaggactatgacaaataaaaaaggaaaaggaattcaaaaacagaaggaaaaggaaacctggtagctttttggccttggattctctctgggctccagatgacctggatgccaagccactgcccctcctctgggggcctccaccctcctctcccggctggaggtttgcctgattttctgggatggg

SEQ ID NO: 300977 - DNA, 2635 bp, Homo sapiens
ctcgcagcagagaggagttgagggcgatgagagcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcgcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggaaagaggcaaagaggggcctgggaccccgactcgaagcagcgtcatcaccagtgctagggagctacactatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacagggtcttctagcataacctttgttcctgttggcaacacttcattttggactgtcaagatgcatttcctgagatgtgagatgtcatgaccctgtgtttggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaagggaggcccgcggcggtggagccgagcggggagccaggaaagaagagttggagtgagatgaaggaaggactatgacaaataaaaaaggaaaaggaattcaaaaacagaaggaaaaggaaacctggtagctttttggccttggattctctctgggctccagatgacctggatgccaagccactgcccctcctctgggggcctccaccctcctctcccggctggaggtttgcctgattttctgggatggg

SEQ ID NO: 300978 - DNA, 1231 bp, Homo sapiens
ctcgcagcagagaggagttgagggcgatgagagcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcgcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggcattgaggcagccagcgcaggggctttctgctgagggggcaggcggagtttgaggaaaccgcagatcagtttttttctcttggaacagatagagattaatacaactactcaaaaaataccactccaaccaaaataaaacaccct

SEQ ID NO: 300979 - DNA, 2889 bp, Homo sapiens
gcgggcgccgcaggagcgagtgagctgggagcgaggggcgaaggcgcggagaagcccggccgcccggtgggcggcagaaggctcagccgaggcggcggcgccgactccgttccactctcggcccggatccaggcctccgggttcccaggcgctcacctccctctgacgcactttaaagagtctccccccttccacctcagggcgagtaatagcgaccaatcatcaagccatttaccaggcttcggaggaagctgtttatgtgatccccgcactaattaggctcatgaactaacaaatcgtttgcacaacttgtgaagaagcgaacacttccatggattgtccttggacttagggcgccctgcccgccttttgcagaggagaaaaaactttttttttttttttgcctcccccgagaactttccccccttctcctccctgcctctaactccgatccccccacgccatctcgccaaaaaaaaaaaaaaaaaaaaaaaagaaaaaaaaagaaaaaaaaagaaaaaaaattaccccaatccacgcctgcaaattcttctggaaggattttcccccctctcttcaggttgggcgcgtttggtgcaagattctcgggatcctcggctttgcctctccctctccctcccccctcctttcctttttcctttcctttcctttctttcttcctttccttccccccacccccacccccaccccaaacaaacgagtccccaattctcgtccgtcctcgccgcgggcagcgggcggcggaggcagcgtgcggcggtcgccaggagctgggagcccagggcgcccgctcctcggcgcagcatgttccagccggcgcccaagcgctgcttcaccatcgagtcgctggtggccaaggacagtcccctgcccgcctcgcgctccgaggaccccatccgtcccgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctggccgcccaccccctaccctcctcgcactcgccacaccccctattcgcctcgcagcagcgggatccgtccaccttctacccctggctcatccaccgctaccgatatctgggtcatcgcttccaagggaacgacactagccccgagagtttccttttgcacaacgcgctggcccgaaagcccaagcggatccgaaccgccttctccccgtcccagcttctaaggctggaacacgcctttgagaagaatcactacgtggtgggcgccgaaaggaagcagctggcacacagcctcagcctcacggaaactcaggtaaaagtatggtttcagaaccgaagaacaaagttcaaaaggcagaagctggaggaagaaggctcagattcgcaacaaaagaaaaaagggacgcaccatattaaccggtggagaatcgccaccaagcaggcgagtccggaggaaatagacgtgacctcagatgattaaaaacataaacctaaccccacagaaacggacaacatggagcaaaagagacagggagaggtggagaaggaaaaaaccctacaaaacaaaaacaaaccgcatacacgttcaccgagaaagggagagggaatcggagggagcagcggaatgcggcgaagactctggacagcgagggcacagggtcccaaaccgaggccgcgccaagatggcagaggatggaggctccttcatcaacaagcgaccctcgtctaaagaggcagctgagtgagagacacagagagaaggagaaagagggagggagagagagaaagagagagaaagagagagagagagagagagaaagctgaacgtgcactctgacaaggggagctgtcaatcaaacaccaaaccggggagacaagatgattggcaggtattccgtttatcacagtccacttaaaaaatgatgatgatgataaaaaccacgacccaaccaggcacaggacttttttgttttttgcacttcgctgtgtttcccccccatctttaaaaataattagtaataaaaaacaaaaattccatatctagccccatcccacacctgtttcaaatccttgaaatgcatgtagcagttgttgggcgaatggtgtttaaagaccgaaaatgaattgtaattttcttttccttttaaagacaggttctgtgtgctttttattttgattttttttcccaagaaatgtgcagtctgtaaacactttttgataccttctgatgtcaaagtgattgtgcaagctaaatgaagtaggctcagcgatagtggtcctcttacagagaaacggggagcaggacgacgggggggctgggggtggcgggggagggtgcccacaaaaagaatcaggacttgtactgggaaaaaaacccctaaattaattatatttcttggacattccctttcctaacatcctgaggcttaaaaccctgatgcaaacttctcctttcagtggttggagaaattggccgagttcaaccattcactgcaatgcctattccaaactttaaatctatctattgcaaaacctgaaggactgtagttagcggggatgatgttaagtgtggccaagcgcacggcggcaagttttcaagcactgagtttctattccaagatcatagacttactaaagagagtgacaaatgcttccttaatgtcttctataccagaatgtaaatatttttgtgttttgtgttaatttgttagaattctaacacactatatacttccaagaagtatgtcaatgtcaatattttgtcaataaagatttatcaatatgc

SEQ ID NO: 300980 - DNA, 2462 bp, Homo sapiens
gcgggcgccgcaggagcgagtgagctgggagcgaggggcgaaggcgcggagaagcccggccgcccggtgggcggcagaaggctcagccgaggcggcggcgccgactccgttccactctcggcccggatccaggcctccgggttcccaggcgctcacctccctctgacgcactttaaagagtctccccccttccacctcagggcgagtaatagcgaccaatcatcaagccatttaccaggcttcggaggaagctgtttatgtgatccccgcactaattaggctcatgaactaacaaatcgtttgcacaacttgtgaagaagcgaacacttccatggattgtccttggacttagggcgccctgcccgccttttgcagaggagaaaaaactttttttttttttttgcctcccccgagaactttccccccttctcctccctgcctctaactccgatccccccacgccatctcgccaaaaaaaaaaaaaaaaaaaaaaaagaaaaaaaaagaaaaaaaaagaaaaaaaattaccccaatccacgcctgcaaattcttctggaaggattttcccccctctcttcaggttgggcgcgtttggtgcaagattctcgggatcctcggctttgcctctccctctccctcccccctcctttcctttttcctttcctttcctttctttcttcctttccttccccccaccctcctcgcactcgccacaccccctattcgcctcgcagcagcgggatccgtccaccttctacccctggctcatccaccgctaccgatatctgggtcatcgcttccaagggaacgacactagccccgagagtttccttttgcacaacgcgctggcccgaaagcccaagcggatccgaaccgccttctccccgtcccagcttctaaggctggaacacgcctttgagaagaatcactacgtggtgggcgccgaaaggaagcagctggcacacagcctcagcctcacggaaactcaggtaaaagtatggtttcagaaccgaagaacaaagttcaaaaggcagaagctggaggaagaaggctcagattcgcaacaaaagaaaaaagggacgcaccatattaaccggtggagaatcgccaccaagcaggcgagtccggaggaaatagacgtgacctcagatgattaaaaacataaacctaaccccacagaaacggacaacatggagcaaaagagacagggagaggtggagaaggaaaaaaccctacaaaacaaaaacaaaccgcatacacgttcaccgagaaagggagagggaatcggagggagcagcggaatgcggcgaagactctggacagcgagggcacagggtcccaaaccgaggccgcgccaagatggcagaggatggaggctccttcatcaacaagcgaccctcgtctaaagaggcagctgagtgagagacacagagagaaggagaaagagggagggagagagagaaagagagagaaagagagagagagagagagagaaagctgaacgtgcactctgacaaggggagctgtcaatcaaacaccaaaccggggagacaagatgattggcaggtattccgtttatcacagtccacttaaaaaatgatgatgatgataaaaaccacgacccaaccaggcacaggacttttttgttttttgcacttcgctgtgtttcccccccatctttaaaaataattagtaataaaaaacaaaaattccatatctagccccatcccacacctgtttcaaatccttgaaatgcatgtagcagttgttgggcgaatggtgtttaaagaccgaaaatgaattgtaattttcttttccttttaaagacaggttctgtgtgctttttattttgattttttttcccaagaaatgtgcagtctgtaaacactttttgataccttctgatgtcaaagtgattgtgcaagctaaatgaagtaggctcagcgatagtggtcctcttacagagaaacggggagcaggacgacgggggggctgggggtggcgggggagggtgcccacaaaaagaatcaggacttgtactgggaaaaaaacccctaaattaattatatttcttggacattccctttcctaacatcctgaggcttaaaaccctgatgcaaacttctcctttcagtggttggagaaattggccgagttcaaccattcactgcaatgcctattccaaactttaaatctatctattgcaaaacctgaaggactgtagttagcggggatgatgttaagtgtggccaagcgcacggcggcaagttttcaagcactgagtttctattccaagatcatagacttactaaagagagtgacaaatgcttccttaatgtcttctataccagaatgtaaatatttttgtgttttgtgttaatttgttagaattctaacacactatatacttccaagaagtatgtcaatgtcaatattttgtcaataaagatttatcaatatgc

SEQ ID NO: 300981 - DNA, 2863 bp, Homo sapiens
gcgggcgccgcaggagcgagtgagctgggagcgaggggcgaaggcgcggagaagcccggccgcccggtgggcggcagaaggctcagccgaggcggcggcgccgactccgttccactctcggcccggatccaggcctccgggttcccaggcgctcacctccctctgacgcactttaaagagtctccccccttccacctcagggcgagtaatagcgaccaatcatcaagccatttaccaggcttcggaggaagctgtttatgtgatccccgcactaattaggctcatgaactaacaaatcgtttgcacaacttgtgaagaagcgaacacttccatggattgtccttggacttagggcgccctgcccgccttttgcagaggagaaaaaactttttttttttttttgcctcccccgagaactttccccccttctcctccctgcctctaactccgatccccccacgccatctcgccaaaaaaaaaaaaaaaaaaaaaaaagaaaaaaaaagaaaaaaaaagaaaaaaaattaccccaatccacgcctgcaaattcttctggaaggattttcccccctctcttcaggttgggcgcgtttggtgcaagattctcgggatcctcggctttgcctctccctctccctcccccctcctttcctttttcctttcctttcctttctttcttcctttccttccccccacccccacccccaccccaaacaaacgagtccccaattctcgtccgtcctcgccgcgggcagcgggcggcggaggcagcgtgcggcggtcgccaggagctgggagcccagggcgcccgctcctcggcgcagcatgttccagccggcgcccaagcgctgcttcaccatcgagtcgctggtggccaaggacagtcccctgcccgcctcgcgctccgaggaccccatccgtcccgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctggccgcccaccccctaccctcctcgcactcgccacaccccctattcgcctcgcagcagcgggatccgtccaccttctacccctggctcatccaccgctaccgatatctgggtcatcgcttccaagggaacgacactagccccgagagtttccttttgcacaacgcgctggcccgaaagcccaagcggatccgaaccgccttctccccgtcccagcttctaaggctggaacacgcctttgagaagaatcactacgtggtgggcgccgaaaggaagcagctggcacacagcctcagcctcacggaaactcaggtaaaagtatggtttcagaaccgaagaacaaagttcaaaaggcagaagctggaggaagaaggctcagattcgcaacaaaagaaaaaagggacgcaccatattaaccggtggagaatcgccaccaagcaggcgagtccggaggaaatagacgtgacctcagatgattaaaaacataaacctaaccccacagaaacggacaacatggagcaaaagagacagggagaggtggagaaggaaaaaaccctacaaaacaaaaacaaaccgcatacacgttcaccgagaaagggagagggaatcggagggagcagcggaatgcggcgaagactctggacagcgagggcacagggtcccaaaccgaggccgcgccaagatggcagaggatggaggctccttcatcaacaagcgaccctcgtctaaagaggcagctgagtgagagacacagagagaaggagaaagagggagggagagagagaaagagagagaaagagagagagagagagaaggggagctgtcaatcaaacaccaaaccggggagacaagatgattggcaggtattccgtttatcacagtccacttaaaaaatgatgatgatgataaaaaccacgacccaaccaggcacaggacttttttgttttttgcacttcgctgtgtttcccccccatctttaaaaataattagtaataaaaaacaaaaattccatatctagccccatcccacacctgtttcaaatccttgaaatgcatgtagcagttgttgggcgaatggtgtttaaagaccgaaaatgaattgtaattttcttttccttttaaagacaggttctgtgtgctttttattttgattttttttcccaagaaatgtgcagtctgtaaacactttttgataccttctgatgtcaaagtgattgtgcaagctaaatgaagtaggctcagcgatagtggtcctcttacagagaaacggggagcaggacgacgggggggctgggggtggcgggggagggtgcccacaaaaagaatcaggacttgtactgggaaaaaaacccctaaattaattatatttcttggacattccctttcctaacatcctgaggcttaaaaccctgatgcaaacttctcctttcagtggttggagaaattggccgagttcaaccattcactgcaatgcctattccaaactttaaatctatctattgcaaaacctgaaggactgtagttagcggggatgatgttaagtgtggccaagcgcacggcggcaagttttcaagcactgagtttctattccaagatcatagacttactaaagagagtgacaaatgcttccttaatgtcttctataccagaatgtaaatatttttgtgttttgtgttaatttgttagaattctaacacactatatacttccaagaagtatgtcaatgtcaatattttgtcaataaagatttatcaatatgc

SEQ ID NO: 300982 - DNA, 3277 bp, Homo sapiens
gcgggcgccgcaggagcgagtgagctgggagcgaggggcgaaggcgcggagaagcccggccgcccggtgggcggcagaaggctcagccgaggcggcggcgccgactccgttccactctcggcccggatccaggcctccgggttcccaggcgctcacctccctctgacgcactttaaagagtctccccccttccacctcagggcgagtaatagcgaccaatcatcaagccatttaccaggcttcggaggaagctgtttatgtgatccccgcactaattaggctcatgaactaacaaatcgtttgcacaacttgtgaagaagcgaacacttccatggattgtccttggacttagggcgccctgcccgccttttgcagaggagaaaaaactttttttttttttttgcctcccccgagaactttccccccttctcctccctgcctctaactccgatccccccacgccatctcgccaaaaaaaaaaaaaaaaaaaaaaaagaaaaaaaaagaaaaaaaaagaaaaaaaattaccccaatccacgcctgcaaattcttctggaaggattttcccccctctcttcaggttgggcgcgtttggtgcaagattctcgggatcctcggctttgcctctccctctccctcccccctcctttcctttttcctttcctttcctttctttcttcctttccttccccccacccccacccccaccccaaacaaacgagtccccaattctcgtccgtcctcgccgcgggcagcgggcggcggaggcagcgtgcggcggtcgccaggagctgggagcccagggcgcccgctcctcggcgcagcatgttccagccggcgcccaagcgctgcttcaccatcgagtcgctggtggccaaggacagtcccctgcccgcctcgcgctccgaggaccccatccgtcccgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctggccgcccaccccctaccctcctcgcactcgccacaccccctattcgcctcgcagcagcgggatccgtccaccttctacccctggctcatccaccgctaccgatatctgggtcatcgcttccaagggaacgacactagccccgagagtttccttttgcacaacgcgctggcccgaaagcccaagcggatccgaaccgccttctccccgtcccagcttctaaggctggaacacgcctttgagaagaatcactacgtggtgggcgccgaaaggaagcagctggcacacagcctcagcctcacggaaactcaggtaaaagtatggtttcagaaccgaagaacaaagttcaaaaggcagaagctggaggaagaaggctcagattcgcaacaaaagaaaaaagggacgcaccatattaaccggtggagaatcgccaccaagcaggcgagtccggaggaaatagacgtgacctcagatgattaaaaacataaacctaaccccacagaaacggacaacatggagcaaaagagacagggagaggtggagaaggaaaaaaccctacaaaacaaaaacaaaccgcatacacgttcaccgagaaagggagagggaatcggagggagcagcggaatgcggcgaagactctggacagcgagggcacagggtcccaaaccgaggccgcgccaagatggcagaggatggaggctccttcatcaacaagcgaccctcgtctaaagaggcagctgagtgagagacacagagagaaggagaaagagggagggagagagagaaagagagagaaagagagagagagagagagagaaagctgaacgtgcactctgacaaggggagctgtcaatcaaacaccaaaccggggagacaagatgattggcaggtattccgtttatcacagtccacttaaaaaatgatgatgatgataaaaaccacgacccaaccaggcacaggacttttttgttttttgcacttcgctgtgtttcccccccatctttaaaaataattagtaataaaaaacaaaaattccatatctagccccatcccacacctgtttcaaatccttgaaatgcatgtagcagttgttgggcgaatggtgtttaaagaccgaaaatgaattgtaattttcttttccttttaaagacaggttctgtgtgctttttattttgattttttttcccaagaaatgtgcagtctgtaaacactttttgataccttctgatgtcaaagtgattgtgcaagctaaatgaagtaggctcagcgatagtggtcctcttacagagaaacggggagcaggacgacgggggggctgggggtggcgggggagggtgcccacaaaaagaatcaggacttgtactgggaaaaaaacccctaaattaattatatttcttggacattccctttcctaacatcctgaggcttaaaaccctgatgcaaacttctcctttcagtggttggagaaattggccgagttcaaccattcactgcaatgcctattccaaactttaaatctatctattgcaaaacctgaaggactgtagttagcggggatgatgttaagtgtggccaagcgcacggcggcaagttttcaagcactgagtttctattccaagatcatagacttactaaagagagtgacaaatgcttccttaatgtcttctataccagaatgtaaatatttttgtgttttgtgttaatttgttagaattctaacacactatatacttccaagaagtatgtcaatgtcaatattttgtcaataaagatttatcaatatgccctcagagtagtcgtcttgggaaattgaagtggatctttaaaaatgtatctcagtaatttgagtgtggtccttccccaactaggctcaagaaacccaggctcctcacccacaaaagggccagattgatggattctcaggcattttaaagaaagatgagggtggagaagggagaagattaggaaaacttaagtccttcagaaaagagatgggagaaaagtttttcaaccagactttgcccattgtatgccctcctgagggagtttagtttgaacttcaggttaaaatgcttacttctcttaacctctggttattaaaaaaaactggacatatagttacacattgaggactactctccccaaatattggggaaaacatgtagcagaatct

SEQ ID NO: 300983 - DNA, 1246 bp, Homo sapiens
cccagggcacagaggccaggatctcacgcgcgaccgcacgaggccgggaccctccctccccttccgtccactcccttccccaccgcctccggtcccctcccggtctccgccaccccgcttcggggcccccgccccccagccgggcagccaatcggagctgggatcccgccccggtccgcaaagccggtggcgcccggaggctgcacggagagcggtgcccgcgtcagtgaccgaaggaagagaccaagatgaatacagagcccgagaggaagtttggcgtggtggtggttggtgttggccgagccggctccgtgcggatgagggacttgcggaatccacacccttcctcagcgttcctgaacctgattggcttcgtgtcgagaagggagctcgggagcattgatggagtccagcagatttctttggaggatgctctttccagccaagaggtggaggtcgcctatatctgcagtgagagctccagccatgaggactacatcaggcagttccttaatgctggcaagcacgtccttgtggaataccccatgacactgtcattggcggccgctcaggaactgtgggagctggctgagcagaaaggaaaagtcttgcacgaggagcatgttgaactcttgatggaggaattcgctttcctgaaaaaagaagtggtggggaaagacctgctgaaagggtcgctcctcttcacagctggcccgttggaagaagagcggtttggcttccctgcattcagcggcatctctcgcctgacctggctggtctccctctttggggagctttctcttgtgtctgccactttggaagagcgaaaggaagatcagtatatgaaaatgacagtgtgtctggagacagagaagaaaagtccactgtcatggattgaagaaaaaggacctggtctaaaacgaaacagatatttaagcttccatttcaagtctgggtccttggagaatgtgccaaatgtaggagtgaataagaacatatttctgaaagatcaaaatatatttgtccagaaactcttgggccagttctctgagaaggaactggctgctgaaaagaaacgcatcctgcactgcctggggcttgcagaagaaatccagaaatattgctgttcaaggaagtaagaggaggaggtgatgtagcacttccaagatggcaccagcatttggttcttctcaagagttgaccattatctctattcttaaaattaaacatgttggggaaacaagaa

SEQ ID NO: 300984 - DNA, 707 bp, Homo sapiens
gccttacacagcagtgcagtactgcaaggactgcctgtgtggaaaacccacctgatggttttccacacaggcagtccttgccttacacagcagtgcagtactgcaaaaatgagcaagcaagctaaaacaccctgcaaaggagtcagaagagccagtgagaaaattacaattgctctgtgaccaatcacagaagtgtcaaaacattaagaaattcttattgctggttataaatatataaggaagtgaaaaatagtaaaattaatatttagtatgtgtaatttgaaacattagaaacattcagaattaaagtgttttatttctctgtaaaaacccatcgagagtagttttcaacagtagtggcctccttcttctcaccagacagtttaggatgtggagccggcatccttggcaaattatcatactcccttctcagtttggatcagcttccaacgttttctcctttgtgctttcaatgtcataaaataacggttgagttcctttaaccctcaggacctggcagctaacagggaagtgccagctgccttcctcagtctagcttccttctaggttcttacagctgctcccaccatgctgtttcccacgggtaagatgcttcctctttatcagtctagctctagagtagacaaaaacacctctccttggctttccttaaccttttctggcaccagagtgtatttccttaagaa

SEQ ID NO: 300985 - DNA, 1340 bp, Homo sapiens
cccagggcacagaggccaggatctcacgcgcgaccgcacgaggccgggaccctccctccccttccgtccactcccttccccaccgcctccggtcccctcccggtctccgccaccccgcttcggggcccccgccccccagccgggcagccaatcggagctgggatcccgccccggtccgcaaagccggtggcgcccggaggctgcacggagagcggtgcccgcgtcagagcctcgccctgtcaccaggctggagtacagtggcgcgatctcggctcactgcaacttccacctgctgggttcaagcaattcttctgacctcagtgaccgaaggaagagaccaagatgaatacagagcccgagaggaagtttggcgtggtggtggttggtgttggccgagccggctccgtgcggatgagggacttgcggaatccacacccttcctcagcgttcctgaacctgattggcttcgtgtcgagaagggagctcgggagcattgatggagtccagcagatttctttggaggatgctctttccagccaagaggtggaggtcgcctatatctgcagtgagagctccagccatgaggactacatcaggcagttccttaatgctggcaagcacgtccttgtggaataccccatgacactgtcattggcggccgctcaggaactgtgggagctggctgagcagaaaggaaaagtcttgcacgaggagcatgttgaactcttgatggaggaattcgctttcctgaaaaaagaagtggtggggaaagacctgctgaaagggtcgctcctcttcacagctggcccgttggaagaagagcggtttggcttccctgcattcagcggcatctctcgcctgacctggctggtctccctctttggggagctttctcttgtgtctgccactttggaagagcgaaaggaagatcagtatatgaaaatgacagtgtgtctggagacagagaagaaaagtccactgtcatggattgaagaaaaaggacctggtctaaaacgaaacagatatttaagcttccatttcaagtctgggtccttggagaatgtgccaaatgtaggagtgaataagaacatatttctgaaagatcaaaatatatttgtccagaaactcttgggccagttctctgagaaggaactggctgctgaaaagaaacgcatcctgcactgcctggggcttgcagaagaaatccagaaatattgctgttcaaggaagtaagaggaggaggtgatgtagcacttccaagatggcaccagcatttggttcttctcaagagttgaccattatctctattcttaaaattaaacatgttggggaaacaagaa

SEQ ID NO: 300986 - DNA, 1418 bp, Homo sapiens
tcccatgcttataaatatttgtactctggtatccacagaatgaaatctgaactgctgagcacagaattgtaggtccttcacagtcaggcccccagctacttttccaacgttattatcctccacggcctgtagtccactcccctgccacactgaagtttgccgattgaacaaagccccacaaatgcccaagcccctgcatacgctgctcacagtgaaatatactcacatgttgcacctggaaaatgtctgctcatactttgagacccagttcataggtccttagtgaaatcttttcagactgcctcaggcaaagctagccgctgtgggttttgtagcctttatagctaccatgtggtgataggaaatttatttgttaatgtgtctttatttctcctccacagtaattggtaaatagtacttagttgaataaatgaatggttgaatgttcaaattaacacataaccagaaagttgatctgtcacaggatagtagaaaacaatgtgggatacagttcttcctccatatcccgtggcactgactcctacccccagtcatgacacattcacacacagaaactctcatgcctttataacattctgttctctattatgcagagcatttcagtgaagcttattcgaagtgttctttctctgtatttgtctcgtttaccaaaggcagttccttaatgctggcaagcacgtccttgtggaataccccatgacactgtcattggcggccgctcaggaactgtgggagctggctgagcagaaaggaaaagtcttgcacgaggagcatgttgaactcttgatggaggaattcgctttcctgaaaaaagaagtggtggggaaagacctgctgaaagggtcgctcctcttcacagctggcccgttggaagaagagcggtttggcttccctgcattcagcggcatctctcgcctgacctggctggtctccctctttggggagctttctcttgtgtctgccactttggaagagcgaaaggaagatcagtatatgaaaatgacagtgtgtctggagacagagaagaaaagtccactgtcatggattgaagaaaaaggacctggtctaaaacgaaacagatatttaagcttccatttcaagtctgggtccttggagaatgtgccaaatgtaggagtgaataagaacatatttctgaaagatcaaaatatatttgtccagaaactcttgggccagttctctgagaaggaactggctgctgaaaagaaacgcatcctgcactgcctggggcttgcagaagaaatccagaaatattgctgttcaaggaagtaagaggaggaggtgatgtagcacttccaagatggcaccagcatttggttcttctcaagagttgaccattatctctattcttaaaattaaacatgttggggaaacaagaa

SEQ ID NO: 300987 - DNA, 1153 bp, Homo sapiens
cccagggcacagaggccaggatctcacgcgcgaccgcacgaggccgggaccctccctccccttccgtccactcccttccccaccgcctccggtcccctcccggtctccgccaccccgcttcggggcccccgccccccagccgggcagccaatcggagctgggatcccgccccggtccgcaaagccggtggcgcccggaggctgcacggagagcggtgcccgcgtcagtgaccgaaggaagagaccaagatgaatacagagcccgagaggaagtttggcgtggtggtggttggtgttggccgagccggctccgtgcggatgagggacttgcggaatccacacccttcctcagcgttcctgaacctgattggcttcgtgtcgagaagggagctcgggagcattgatggagtccagcagatttctttggaggatgctctttccagccaagaggtggaggtcgcctatatctgcagtgagagctccagccatgaggactacatcagggttttccacacaggcagtccttgccttacacagcagtgcagtactgcaaaaatgagcaagcaagctaaaacaccctgcaaaggagtcagaagagccagtgagaaaattacaattgctctgtgaccaatcacagaagtgtcaaaacattaagaaattcttattgctggttataaatatataaggaagtgaaaaatagtaaaattaatatttagtatgtgtaatttgaaacattagaaacattcagaattaaagtgttttatttctctgtaaaaacccatcgagagtagttttcaacagtagtggcctccttcttctcaccagacagtttaggatgtggagccggcatccttggcaaattatcatactcccttctcagtttggatcagcttccaacgttttctcctttgtgctttcaatgtcataaaataacggttgagttcctttaaccctcaggacctggcagctaacagggaagtgccagctgccttcctcagtctagcttccttctaggttcttacagctgctcccaccatgctgtttcccacgggtaagatgcttcctctttatcagtctagctctagagtagacaaaaacacctctccttggctttccttaaccttttctggcaccagagtgtatttccttaagaa

SEQ ID NO: 300988 - DNA, 330 bp, Homo sapiens
caagcacccacttgtgctcttgtgtaatctctaacatgattcttttgtcttttgtctttgcagtccactgtcatggattgaagaaaaaggacctggtctaaaacgaaacagatatttaagcttccatttcaagtctgggtccttggagaatgtgccaaatgtaggagtgaataagaacatatttctgaaagatcaaaatatatttgtccagaaactcttgggccagttctctgagaaggaactggctgctgaaaagaaacgcatcctgcactgcctggggcttgcagaagaaatccagaaatattgctgttcaaggaagtaagaggagga

SEQ ID NO: 300989 - DNA, 608 bp, Homo sapiens
ccagaatgttgacagtcgctctcctagcccttctctgtgcctcagcctctggcaatgccattcaggccaggtcttcctcctatagtggagagtatggaagtggtggtggaaagcgattctctcattctggcaaccagttggacggccccatcaccgccctccgggtccgagtcaacacatactacatcgtaggtcttcaggtgcgctatggcaaggtgtggagcgactatgtgggtggtcgcaacggagacctggaggagatctttctgcaccctggggaatcagtgatccaggtttctgggaagtacaagtggtacctgaagaagctggtatttgtgacagacaagggccgctatctgtcttttgggaaagacagtggcacaagtttcaatgccgtccccttgcaccccaacaccgtgctccgcttcatcagtggccggtctggttctctcatcgatgccattggcctgcactgggatgtttaccccactagctgcagcagatgctgagcctcctctccttggcaggggcactgtgatgaggagtaagaactcccttatcactaacccccatccaaatggctcaataaaaaaatatggttaaggcta

SEQ ID NO: 300990 - DNA, 668 bp, Homo sapiens
tccaactcctgcttgcccctccagttcaggccaggtcttcctcctatagtggagagtatggaagtggtggtggaaagcgattctctcattctggcaaccagttggacggccccatcaccgccctccgggtccgagtcaacacatactacatcgtagggtaagattctttgaattcctggctgggcgcggtggctcacatctgtcattacaatgctttgggaggcagaggcagatcgcttgaggccaggagttctagctcagcctgggcaagatgccagggatgccagggatttaaaccatgctccaggtaccaagaccccatctctaccgaagaaaaacaaaaaaattagccaggcatggtggtgagtacctgtagcctcaactactcaggagggagaggcgggaggattgcctgagcccaggatgttgaggctgcagtgagccaagatcatgccactgcactccagcctgggtgacagagtctctttgttggcaaaatgagttgaagttccctgtaggatcttccagggttcacccaggcttcacagtctgtaggactagccagagacctctcatccctatcatcacctttctttctccttccttcctcccctcttcctcagtcttcaggtgcgctatggcaaggtgtggagcgactatgtgggtgg

SEQ ID NO: 300991 - DNA, 2989 bp, Homo sapiens
cgtagtgatgcgacggggaaattcaaacgtgtttgcggaaaggagtttgggttccatcttttcatttccccagcgcagctttctgtagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcagcatctacggtattaactgcccaagaatcattttccggttcacttgggcatttacagaataggaacaacagttgtgattccagaggacagactactaaagccaggtttttatatggagagaacatgccaccacaagatgcagaaataggttaccggaattcattgagacaaactaacaaaactaaacagtcatgcccatttggaagagtcccagttaaccttctaaatagcccagattgtgatgtgaagacagatgattcagttgtaccttgttttatgaaaagacaaacctctagatcagaatgccgagatttggttgtgcctggatctaaaccaagtggaaatgattcctgtgaattaagaaatttaaagtctgttcaaaatagtcatttcaaggaacctctggtgtcagatgaaaagagttctgaacttattattactgattcaataaccctgaagaataaaacggaatcaagtcttctagctaaattagaagaaactaaagagtatcaagaaccagaggttccagagagtaaccagaaacagtggcaatctaagagaaagtcagagtgtattaaccagaatcctgctgcatcttcaaatcactggcagattccggagttagcccgaaaagttaatacagagcagaaacataccacttttgagcaacctgtcttttcagtttcaaaacagtcaccaccaatatcaacatctaaatggtttgacccaaaatctatttgtaagacaccaagcagcaataccttggatgattacatgagctgttttagaactccagttgtaaagaatgactttccacctgcttgtcagttgtcaacaccttatggccaacctgcctgtttccagcagcaacagcatcaaatacttgccactccacttcaaaatttacaggttttagcatcttcttcagcaaatgaatgcatttcggttaaaggaagaatttattccatattaaagcagataggaagtggaggttcaagcaaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattatgaaatcacggaccagtacatctacatggtaatggagtgtggaaatattgatcttaatagttggcttaaaaagaaaaaatccattgatccatgggaacgcaagagttactggaaaaatatgttagaggcagttcacacaatccatcaacatggcattgttcacagtgatcttaaaccagctaactttctgatagttgatggaatgctaaagctaattgattttgggattgcaaaccaaatgcaaccagatacaacaagtgttgttaaagattctcaggttggcacagttaattatatgccaccagaagcaatcaaagatatgtcttcctccagagagaatgggaaatctaagtcaaagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaagtgttgtttaaaaagggacccaaaacagaggatatccattcctgagctcctggctcatccatatgttcaaattcaaactcatccagttaaccaaatggccaagggaaccactgaagaaatgaaatatgttctgggccaacttgttggtctgaattctcctaactccattttgaaagctgctaaaactttatatgaacactatagtggtggtgaaagtcataattcttcatcctccaagacttttgaaaaaaaaaggggaaaaaaatgatttgcagttattcgtaatgtcagataccacctataaaatatattggactgttatactcttgaatccctgtggaaatctacatttgaagacaacatcactctgaagtgttatcagcaaaaaaaattcagtagattatctttaaaagaaaactgtaaaaatagcaaccacttatggcactgtatatattgtagacttgttttctctgttttatgctcttgtgtaatctacttgacatcattttactcttggaatagtgggtggatagcaagtatattctaaaaaactttgtaaataaagttttgtggctaaaatgacactaacattt

SEQ ID NO: 300992 - DNA, 984 bp, Homo sapiens
gaattccgcacgtaaaaaggatgcagagacatgtgcatgcgccaaaatttacaggttttagcatcttcttcagcaaatgaatgcatttcggttaaaggaagaatttattccatattaaagcagataggaagtggaggttcaagcaaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattatgaaatcacggaccagtacatctacatggtaatggagtgtggaaatattgatcttaatagttggcttaaaaagaaaaaatccattgatccatgggaacgcaagagttactggaaaaatatgttagaggcagttcacacaatccatcaacatggcattgttcacagtgatcttaaaccagctaactttctgatagttgatggaatgctaaagctaattgattttgggattgcaaaccaaatgcaaccagatacaacaagtgttgttaaagattctcaggttggcacagttaattatatgccaccagaagcaatcaaagatatgtcttcctccagagagaatgggaaatctaagtcaaagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaagtgttgtttaaaaagggacccaaaacagaggatatccattcctgagctcctggctcatccatatgttcaaattcaaactcatccagttaacaatggcagggaacactgagaatgaattgttggcactgtgttgattctactcatt

SEQ ID NO: 300993 - DNA, 846 bp, Homo sapiens
cgtagtgatgcgacggggaaattcaaacgtgtttgcggaaaggagtttgggttccatcttttcatttccccagcgcagctttctgtagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcagcatcctacgggtattaactggcccaagaactcattttcccggtttcacttgggccttttacagaaatcggcaccaacaggttgttggattcccagaaggaccggactacttaaaagccaggttctatcattgcggcggaacct

SEQ ID NO: 300994 - DNA, 650 bp, Homo sapiens
cgtagtgatgcgacggggaaattcaaacgtgtttgcggaaaggagtttgggttccatcttttcatttccccagcgcagctttctgtagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatctgaaaatgtcaaattcaaattttaagtaaaggataacttattacaacttacttcctaatattaaatcatatatatgaagtggaaa

SEQ ID NO: 300995 - DNA, 2901 bp, Homo sapiens
cgtagtgatgcgacggggaaattcaaacgtgtttgcggaaaggagtttgggttccatcttttcatttccccagcgcagctttctgtagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcagcatctacggtattaactgcccaagaatcattttccggttcacttgggcatttacagaataggaacaacagttgtgattccagaggacagactactaaagccaggtttttatatggagagaacatgccaccacaagatgcagaaataggttaccggaattcattgagacaaactaacaaaactaaacagtcatgcccatttggaagagtcccagttaaccttctaaatagcccagattgtgatgtgaagacagatgattcagttgtaccttgttttatgaaaagacaaacctctagatcagaatgccgagatttggttgtgcctggatctaaaccaagtggaaatgattcctgtgaattaagaaatttaaagtctgttcaaaatagtcatttcaaggaacctctggtgtcagatgaaaagagttctgaacttattattactgattcaataaccctgaagaataaaacggaatcaagtcttctagctaaattagaagaaactaaagagtatcaagaaccagaggttccagagagtaaccagaaacagtggcaatctaagagaaagtcagagtgtattaaccagaatcctgctgcatcttcaaatcactggcagattccggagttagcccgaaaagttaatacagagcagaaacataccacttttgagcaacctgtcttttcagtttcaaaacagtcaccaccaatatcaacatctaaatggtttgacccaaaatctatttgtaagacaccaagcagcaataccttggatgattacatgagctgttttagaactccagttgtaaagaatgactttccacctgcttgtcagttgtcaacaccttatggccaacctgcctgtttccagcagcaacagcatcaaatacttgccactccacttcaaaatttacaggttttagcatcttcttcagcaaatgaatgcatttcggttaaaggaagaatttattccatattaaagcagataggaagtggaggttcaagcaaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattatgaaatcacggaccagtacatctacatggtaatggagtgtggaaatattgatcttaatagttgggcattgttcacagtgatcttaaaccagctaactttctgatagttgatggaatgctaaagctaattgattttgggattgcaaaccaaatgcaaccagatacaacaagtgttgttaaagattctcaggttggcacagttaattatatgccaccagaagcaatcaaagatatgtcttcctccagagagaatgggaaatctaagtcaaagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaagtgttgtttaaaaagggacccaaaacagaggatatccattcctgagctcctggctcatccatatgttcaaattcaaactcatccagttaaccaaatggccaagggaaccactgaagaaatgaaatatgttctgggccaacttgttggtctgaattctcctaactccattttgaaagctgctaaaactttatatgaacactatagtggtggtgaaagtcataattcttcatcctccaagacttttgaaaaaaaaaggggaaaaaaatgatttgcagttattcgtaatgtcagataccacctataaaatatattggactgttatactcttgaatccctgtggaaatctacatttgaagacaacatcactctgaagtgttatcagcaaaaaaaattcagtagattatctttaaaagaaaactgtaaaaatagcaaccacttatggcactgtatatattgtagacttgttttctctgttttatgctcttgtgtaatctacttgacatcattttactcttggaatagtgggtggatagcaagtatattctaaaaaactttgtaaataaagttttgtggctaaaatgacactaacattt

SEQ ID NO: 300996 - DNA, 2541 bp, Homo sapiens
cgtagtgatgcgacggggaaattcaaacgtgtttgcggaaaggagtttgggttccatcttttcatttccccagcgcagctttctgtagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcagcatctacggtattaactgcccaagaatcattttccggttcacttgggcatttacagaataggaacaacagttgtgattccagaggacagactactaaagccaggtttttatatggagagaacatgccaccacaagatgcagaaataggttaccggaattcattgagacaaactaacaaaactaaacagtcatgcccatttggaagagtcccagttaaccttctaaatagcccagattgtgatgtgaagacagatgattcagttgtaccttgttttatgaaaagacaaacctctagatcagaatgccgagatttggttgtgcctggatctaaaccaagtggaaatgattcctgtgaattaagaaatttaaagtctgttcaaaatagtcatttcaaggaacctctggtgtcagatgaaaagagttctgaacttattattactgattcaataaccctgaagaataaaacggaatcaagtcttctagctaaattagaagaaactaaagagtatcaagaaccagaggttccagagagtaaccagaaacagtggcaatctaagagaaagtcagagtgtattaaccagaatcctgctgcatcttcaaatcactggcagattccggagttagcccgaaaagttaatacagagcagaaacataccacttttgagcaacctgtcttttcagtttcaaaacagtcaccaccaatatcaacatctaaatggtttgacccaaaatctatttgtaagacaccaagcagcaataccttggatgattacatgagctgttttagaactccagttgtaaagaatgactttccacctgcttgtcagttgtcaacaccttatggccaacctgcctgtttccagcagcaacagcatcaaatacttgccactccacttcaaaatttacaggttttagcatcttcttcagcaaatgaatgcatttcggttaaaggaagaatttattccatattaaagcagataggaagtggaggttcaagcaaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattatgaaatcacggaccagtacatctacatggtaatggagtgtggaaatattgatcttaatagttggcttaaaaagaaaaaatccattgatccatgggaacgcaagagttactggaaaaatatgttagaggcagttcacacaatccatcaacatggcattgttcacagtgatcttaaaccagctaactttctgatagttgatggaatgctaaagctaattgattttgggattgcaaaccaaatgcaaccagatacaacaagtgttgttaaagattctcaggttggcacagttaattatatgccaccagaagcaatcaaagatatgtcttcctccagagagaatgggaaatctaagtcaaagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaagtgttgtttaaaaagggacccaaaacagaggatatccattcctgagctcctggctcatccatatgttcaaattcaaactcatccagttaacaatggcagggaacactgagaatgaattgttggcactgtgttgattctactcatt

SEQ ID NO: 300997 - DNA, 2379 bp, Homo sapiens
  misc_feature (2325)..(2325): n is a, c, g, or t
  misc_feature (2344)..(2344): n is a, c, g, or t
  misc_feature (2350)..(2350): n is a, c, g, or t
cgtagtgatgcgacggggaaattcaaacgtgtttgcggaaaggagtttgggttccatcttttcatttccccagcgcagctttctgtagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcagcatctacggtattaactgcccaagaatcattttccggttcacttgggcatttacagaataggaacaacagttgtgattccagaggacagactactaaagccaggtttttatatggagagaacatgccaccacaagatgcagaaataggttaccggaattcattgagacaaactaacaaaactaaacagtcatgcccatttggaagagtcccagttaaccttctaaatagcccagattgtgatgtgaagacagatgattcagttgtaccttgttttatgaaaagacaaacctctagatcagaatgccgagatttggttgtgcctggatctaaaccaagtggaaatgattcctgtgaattaagaaatttaaagtctgttcaaaatagtcatttcaaggaacctctggtgtcagatgaaaagagttctgaacttattattactgattcaataaccctgaagaataaaacggaatcaagtcttctagctaaattagaagaaactaaagagtatcaagaaccagaggttccagagagtaaccagaaacagtggcaatctaagagaaagtcagagtgtattaaccagaatcctgctgcatcttcaaatcactggcagattccggagttagcccgaaaagttaatacagagcagaaacataccacttttgagcaacctgtcttttcagtttcaaaacagtcaccaccaatatcaacatctaaatggtttgacccaaaatctatttgtaagacaccaagcagcaataccttggatgattacatgagctgttttagaactccagttgtaaagaatgactttccacctgcttgtcagttgtcaacaccttatggccaacctgcctgtttccagcagcaacagcatcaaatacttgccactccacttcaaaatttacaggttttagcatcttcttcagcaaatgaatgcatttcggttaaaggaagaatttattccatattaaagcagataggaagtggaggttcaagcaaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattatgaaatcacggaccagtacatctacatggtaatggagtgtggaaatattgatcttaatagttgggcattgttcacagtgatcttaaaccagctaactttctgatagttgatggaatgctaaagctaattgattttgggattgcaaaccaaatgcaaccagatacaacaagtgttgttaaagattctcaggttggcacagttaattatatgccaccagaagcaatcaaagatatgtcttcctccagagagaatgggaaatctaagtcaaagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaagtggttggttaaaaaangggaccccaaaaccagganggattnttccatttccctggagccttcctgggctt

SEQ ID NO: 300998 - DNA, 460 bp, Homo sapiens
gagccgggccgcccgcggctgtttgctgccctccggccggccgcgttatctgggggccagttcggcctcctttccctaggtcttttcggaggcggagtttagtatccaagtccgcgggtgtgagcgcgcgcgtgtgtcggcgcgcctcgcccggcgcccccgccagtcctgccggaagatggtcaacgaccggtggaagaccatgggcggcgctgcccaacttgaggaccggccgcgcgacaagccgcagacaaatcagccccgttgctgagtctccgtttcctcacctctacaatgggcatcttaactacccacagaatctccactctgggcgctaccctgtgccaggcacctggtcctgaacctgaccccctgaatctcctctgcatccttccctttagccagggccctgcatacagtaggggatcaataaagattcatctcctgcaaaaaaaaaaaa

SEQ ID NO: 300999 - DNA, 852 bp, Homo sapiens
acggcgcgcagcgcgagcggcgggcgttgggctggcggctttcgcgctcccgctcctgctcccgcccgcacacagcggcgcgctcatcctcacacgcccgcccgctcccgggccgccccggcgcggggcacagaggcggggacccggcggacagagcgcgccccgcgcccgcgcccgcgcccaccccgtctcctttgcgctccgcagcggcgcgcctcgcccggcgcccccgccagtcctgccggaagatggtcaacgaccggtggaagaccatgggcggcgctgcccaacttgaggaccggccgcgcgacaagccgcagcggccgagctgcggctacgtgctgtgcaccgtgctgctggccctggctgtgctgctggctgtagctgtcaccggtgccgtgctcttcctgaaccacgcccacgcgccgggcacggcgcccccacctgtcgtcagcactggggctgccagcgccaacagcgccctggtcactgtggaaagggcggacagctcgcacctcagcatcctcattgacccgcgctgccccgacctcaccgacagcttcgcacgcctggagagcgcccaggcctcggtgctgcaggcgctgacagagcaccaggcccagccacggctggtgggcgaccaggagcaggagctgctggacacgctggccgaccagctgccccggctgctggcccgagcctcagagctgcagacggagtgcatggggctgcggaaggggcatggcacgctgggccagggcctcagcgccctgcagagtgagcagggccgcctcatccagctggctctctgtcccagtgccaccaggtcatccacatgcgcaaatgtctgca

SEQ ID NO: 301000 - DNA, 2767 bp, Homo sapiens
gagccgggccgcccgcggctgtttgctgccctccggccggccgcgttatctgggggccagttcggcctcctttccctaggtcttttcggaggcggagtttagtatccaagtccgcgggtgtgagcgcgcgcgtgtgtcggcgcgcctcgcccggcgcccccgccagtcctgccggaagatggtcaacgaccggtggaagaccatgggcggcgctgcccaacttgaggaccggccgcgcgacaagccgcagcggccgagctgcggctacgtgctgtgcaccgtgctgctggccctggctgtgctgctggctgtagctgtcaccggtgccgtgctcttcctgaaccacgcccacgcgccgggcacggcgcccccacctgtcgtcagcactggggctgccagcgccaacagcgccctggtcactgtggaaagggcggacagctcgcacctcagcatcctcattgacccgcgctgccccgacctcaccgacagcttcgcacgcctggagagcgcccaggcctcggtgctgcaggcgctgacagagcaccaggcccagccacggctggtgggcgaccaggagcaggagctgctggacacgctggccgaccagctgccccggctgctggcccgagcctcagagctgcagacggagtgcatggggctgcggaaggggcatggcacgctgggccagggcctcagcgccctgcagagtgagcagggccgcctcatccagcttctctctgagagccagggccacatggctcacctggtgaactccgtcagcgacatcctggatgccctgcagagggaccgggggctgggccggccccgcaacaaggccgaccttcagagagcgcctgcccggggaacccggccccggggctgtgccactggctcccggccccgagactgtctggacgtcctcctaagcggacagcaggacgatggcgtctactctgtctttcccacccactacccggccggcttccaggtgtactgtgacatgcgcacggacggcggcggctggacggtgtttcagcgccgggaggacggctccgtgaacttcttccggggctgggatgcgtaccgagacggctttggcaggctcaccggggagcactggctaggaccgctagaccggtgcaccttgtccttggccctgctggtccctgtcgccccatccccgaccccacctcactctttcgtgaatgttctccacccacctgtgcctggcggacccactctccagtagggaggggccgggccatccctgacacgaagctccctgggccggtgaagtcacacatcgccttctcgccgtccccaccccctccatttggcagctcactgatctcttgcctctgctgatgggggctggcaaacttgacgaccccaactcctgcctgcccccaccgtgactccggtgctgtttgccgtcccctggccaggatggtggagtctgccccaggcaccctctgccctgcccggccaaatacccggcattatggggacagagagcagggggcagacagcacccctggagtcctcctagcagatcgtggggaacgtcaggtctctctgaggtcaggtctgaggccagtatcctccagccctcccaatgccaacccccaccccgtttccctggtgcccagagaacccacctctcccccaagggcctcagcctggctgtgggctgggtggccccatcctaccaggccctgaggtcaggatggggagctgctgcctttggggacccacgctccaaggctgagaccagttccctggaggccacccaccctgtgccccggcaggcctggggtctgcagtcctcttacctgctgtgcccacctgctctctgtctcaaatgaggcccaacccatcccccacccagctcccggccgtcctcctacctggggcagctggggctgccatcccatttctcctgcctctggaaggtgggtggggccctgcaccgtggggctggactgcgctaatgggaagctcttggttttctgggctggggcctaggcagggctgggatgaggcttgtacaacccccaccaccaatttcccagggactccagggtcctgaggcctcccaggagggccttgggggtgatgaccccttccctgaggtggctgtctccatgaggaggccaacccttgccattgaccgtggccacctggacccaggccaggcccggcccggcgagtggtcaagggacagggaccacctcaccgggcaaatggggtcggggggactggggcaccagaccaggcaccacctggacactttcttgttgaatcctcccaacacccagcacgctgtcatccccactccttgtgtgcacacatgcagaggtgagacccgcaggctcccaggaccagcagccacaagggcagggctggagccgggtcctcagctgtctgctcagcagccctggacccgcgtgcgttacgtcaggcccagatgcagggcggcttttccaaggcctcctgatggggggcctccgaaagggctggagtcagccttggggagctgcctagcagcctctcctcgggcaggaggggaggtggcttcctccaaaggacacccgatggcaggtgcctagggggtgtggggttccgttctcccttcccctcccactgaagtttgtgcttaaaaaacaataaatttgacttggcaccactgggggttggtgggagaggccgtgtgacctggctctctgtcccagtgccaccaggtcatccacatgcgcaaatgtctgca

SEQ ID NO: 301001 - DNA, 2059 bp, Homo sapiens
acgccctgaccacacaggctgcctacgagctgcacgtggacctggaggactttgagaatggcacggcctatgcccgctacgggagcttcggcgtgggcttgttctccgtggaccctgaggaagacgggtacccgctcaccgtggctgactattccggcactgcaggcgactccctcctgaagcacagcggcatgaggttcaccaccaaggaccgtgacagcgaccattcagagaacaactgtgccgccttctaccgcggtgcctggtggtaccgcaactgccacacgtccaacctcaatgggcagtacctgcgcggtgcgcacgcctcctatgccgacggcgtggagtggtcctcctggaccggctggcagtactcactcaagttctctgagatgaagatccggccggtccgggaggaccgctagaccggtgcaccttgtccttggccctgctggtccctgtcgccccatccccgaccccacctcactctttcgtgaatgttctccacccacctgtgcctggcggacccactctccagtagggaggggccgggccatccctgacacgaagctccctgggccggtgaagtcacacatcgccttctcgccgtccccaccccctccatttggcagctcactgatctcttgcctctgctgatgggggctggcaaacttgacgaccccaactcctgcctgcccccaccgtgactccggtgctgtttgccgtcccctggccaggatggtggagtctgccccaggcaccctctgccctgcccggccaaatacccggcattatggggacagagagcagggggcagacagcacccctggagtcctcctagcagatcgtggggaacgtcaggtctctctgaggtcaggtctgaggccagtatcctccagccctcccaatgccaacccccaccccgtttccctggtgcccagagaacccacctctcccccaagggcctcagcctggctgtgggctgggtggccccatcctaccaggccctgaggtcaggatggggagctgctgcctttggggacccacgctccaaggctgagaccagttccctggaggccacccaccctgtgccccggcaggcctggggtctgcagtcctcttacctgctgtgcccacctgctctctgtctcaaatgaggcccaacccatcccccacccagctcccggccgtcctcctacctggggcagctggggctgccatcccatttctcctgcctctggaaggtgggtggggccctgcaccgtggggctggactgcgctaatgggaagctcttggttttctgggctggggcctaggcagggctgggatgaggcttgtacaacccccaccaccaatttcccagggactccagggtcctgaggcctcccaggagggccttgggggtgatgaccccttccctgaggtggctgtctccatgaggaggccaacccttgccattgaccgtggccacctggacccaggccaggcccggcccggcgagtggtcaagggacagggaccacctcaccgggcaaatggggtcggggggactggggcaccagaccaggcaccacctggacactttcttgttgaatcctcccaacacccagcacgctgtcatccccactccttgtgtgcacacatgcagaggtgagacccgcaggctcccaggaccagcagccacaagggcagggctggagccgggtcctcagctgtctgctcagcagccctggacccgcgtgcgttacgtcaggcccagatgcagggcggcttttccaaggcctcctgatggggggcctccgaaagggctggagtcagccttggggagctgcctagcagcctctcctcgggcaggaggggaggtggcttcctccaaaggacacccgatggcaggtgcctagggggtgtggggttccgttctcccttcccctcccactgaagtttgtgcttaaaaaacaataaatttgacttggcaccactgggggttggtgggagaggccgtgtgacctggctctctgtcccagtgccaccaggtcatccacatgcgcaaatgtctgca

SEQ ID NO: 301002 - DNA, 986 bp, Homo sapiens
  misc_feature (1)..(1): n is a, c, g, or t
  misc_feature (38)..(38): n is a, c, g, or t
ntcatgcgtgactgactctcttacctaccaccgctacngaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccacccccccacccccttcggttaactactttttaattgcaattctaggtaattgtgcatcgtgatgtgattgcttggctattgtctgaatatttccttttaattttttaattaaagactaatgctttgattggatttgccagttcaccggacagtgattaaaactatgtaatgaatataatcggtttcagtgcaactggatggtctgcttttaaatgtgacttaatctgactgcagtaactagtacagttcaataaagggaatccatgcgatta

SEQ ID NO: 301003 - DNA, 481 bp, Homo sapiens
aggcccatctctgttctctctttcagttgaagagggggaggcctcagacttctcgctggcctgggattcctccgtgacagcagcaggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggaggtaatgcaaaacagccccaggactctgacaggtggttacacgggtaattggacatagcaacagcttgaagcctcaagtgagattaaagaattaataatgtaattttacagttaatgtcattttattgtggtgtcttgggtaccctgtatccgccttttaaatacaattaaaaataaaagcaacagctttccggc

SEQ ID NO: 301004 - DNA, 4534 bp, Homo sapiens
aggcccatctctgttctctctttcagttgaagagggggaggcctcagacttctcgctggcctgggattcctccgtgacagcagcaggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgcgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgcggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccacccccccacccccttcggttaactactttttaattgcaattctaggtaattgtgcatcgtgatgtgattgcttggctattgtctgaatatttccttttaattttttaattaaagactaatgctttgattggatttgccagttcaccggacagtgattaaaactatgtaatgaatataatcggtttcagtgcaactggatggtctgcttttaaatgtgacttaatctgactgcagtaactagtacagttcaataaagggaatccatgcgatta

SEQ ID NO: 301005 - DNA, 4418 bp, Homo sapiens
aggcccatctctgttctctctttcagttgaagagggggaggcctcagacttctcgctggcctgggattcctccgtgacagcagcaggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgcgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgcggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccacccccccacccccttcggttaactactttttaattgcaattctaggtaattgtgcatcgtgatgtgattgcttggctattgtctgaatatttccttttaattttttaattaaagactaatgctttgattggatttgccagttcaccggacagtgattaaaactatgtaatgaatataatcggtttcagtgcaactggatggtctgcttttaaatgtgacttaatctgactgcagtaactagtacagttcaataaagggaatccatgcgatta

SEQ ID NO: 301006 - DNA, 4445 bp, Homo sapiens
aggcccatctctgttctctctttcagttgaagagggggaggcctcagacttctcgctggcctgggattcctccgtgacagcagcaggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgcgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgcggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagttggccctgacagccgtgtctgtgtctagtcttcgtccaggccaacaagttgcagcagcacatctttgccgtgcacgggcagactgctcacagtgccctcagaagttcttcttccagaccgagctgcagaaccacacgatgagccagcacgcacagtgagggatctccgcagaaggcttgccggagacgccgtggggagggccatttgaacattacatccaatcaaagtgtcatttgcaacccagatgtaaaactgcgctgctattataagcagctggaaatgaatattaatggcagagattaaaagtattccatgctcagtattttttattgtcctgctacagctagccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccacccccccacccccttcggttaactactttttaattgcaattctaggtaattgtgcatcgtgatgtgattgcttggctattgtctgaatatttccttttaattttttaattaaagactaatgctttgattggatttgccagttcaccggacagtgattaaaactatgtaatgaatataatcggtttcagtgcaactggatggtctgcttttaaatgtgacttaatctgactgcagtaactagtacagttcaataaagggaatccatgcgatta

SEQ ID NO: 301007 - DNA, 296 bp, Homo sapiens
actgagagttcaacctcagcctgagactgtcttggaatctccttgggattgctcctgttgaccctcagattgcaaagtgtcatggaggctgcttagtttcaggaccaactgaggcctttagatccacgggagcatgcagaatgtggacatgtgggaagtcaggtgtgcgggtggtgatgctggctgatgctgaggtgggactcagttctgctgaagtcccggtttttttgtaaatgcaaaactcagaacacttttccatggatttcgtttcagtgcaagcagcattttctccttgg

SEQ ID NO: 301008 - DNA, 4009 bp, Homo sapiens
gagggactgcggcagtgtcggagccgcgccgagcctggtggcccaggtgccccgcccgcgtcagccctgctccagccccgcgctagcccagcgcccctcgccccgggccgtccggaccgcgcccccgcccagggccttgcgcacgccggggcccaggccgagggccgcagcgccggggccggcgatgagcgcgaggagccggcatgagcgcagacagcagccctctcgtgggcagcacgcccaccggttatgggaccctgacgatagggacatcaatagatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcggtgagtgtcggacagaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggttctgcacggcaaaagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaagacgggcaccctcactgaggacggcttagacgtgatgggggtggtgcccctgaaggggcaggcattcctgcccctggtcccagagcctcgccgcctgcctgtggggcccctgctccgagcactggccacctgccatgccctcagccggctccaggacacccccgtgggcgaccccatggacttgaagatggtggagtctactggctgggtcctggaggaagagccggctgcagactcagcatttgggacccaggtcttggcagtgatgagacctccactttgggagccccagctgcaggcaatggaggagcccccggtgccagtcagcgtcctccaccgcttccccttctcttcggctctgcagcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcagacaacgccagttatccaggctctgcgaaggacccgcatccgcgccgtcatggtgacaggggacaacctgcagacagcggtgactgtggcccggggctgtggcatggtggccccccaggagcatctgatcatcgtccacgccacccaccctgagcggggtcagcctgcctctctcgagttcctgccgatggagtcccccacagccgtgaatggcgttaaggatcctgaccaggctgcaagctacaccgtggagccagacccccgatccaggcacctggccctcagcgggcccacctttggtatcattgtgaagcacttccccaagctgctgcccaaggtcctggtccagggcactgtctttgcccgcatggcccctgagcagaagacagagctggtgtgcgagctacagaagcttcagtactgcgtgggcatgtgcggagacggcgccaatgactgtggggccctgaaggcggctgatgtcggcatctcgctgtcccaggcagaagcctcagtggtctcacccttcacctcgagcatggccagtattgagtgcgtgcccatggtcatcagggaggggcgctgttcccttgacacttcgttcagcgtcttcaagtacatggctctgtacagcctgacccagttcatctccgtcctgatcctctacacgatcaacaccaacctgggtgacctgcagttcctggccatcgacctggtcatcaccaccacagtggcagtgctcatgagccgcacggggccagcgctggtcctgggacgggtgcggccaccgggggcgctgctcagcgtgcccgtgctcagcagcctgctgctgcagatggtcctggtgaccggcgtgcagctagggggctacttcctgaccctggcccagccatggttcgtgcctctgaacaggacagtggccgcaccagacaacctgcccaactacgagaacaccgtggtcttctctctgtccagcttccagtacctcatcctggctgcagccgtgtccaagggggcgcccttccgccggccgctctacaccaatgtgcccttcctggtggccctggcgctcctgagctccgtcctggtgggccttgtcctggtccccggcctcctgcaggggccgctggcgctgaggaacatcactgacaccggcttcaagctgctgctgctgggtctggtcaccctcaacttcgtgggggccttcatgctggagagcgtgctagaccagtgcctccccgcctgcctgcgccgcctccggcccaagcgggcctccaagaagcgcttcaagcagctggaacgagagctggccgagcagccctggccgccgctgcccgccggccccctgaggtagtgcaggcccacgggcaccccagacactggaactccctgcctctgagccaccaactggacccctctccagcaacaccaccgccaccacctcccacatccctgaggttggcgactgtctacactcctcccccgagaccacccccaccctggggaagcgttgactactgtcccctaccttggaccatcccgcgtaggggtggcagcccccagctcccctcagtgctgctgtcagtgtagcaaataaagtcatgatattttcctggc

SEQ ID NO: 301009 - DNA, 900 bp, Homo sapiens
ctggggctagagaagcgcagtgagggtcagggtcgggggtggaggatgcttgggtgccaacccggccactgactttccatgggacattaggcaggtcccgctcttctctggacctcagctttcccatctgagcattgggcagaagggacgggtcgggtggtttctggagggctctccatagccttgatttctgccttctccagcaggggccgcctggctgtaggacagggcctgggaggggaggggactcttctgagactgagtccatacctctgtgttccaggatagttcctggcagctcttcactgtccaggtgcagactgaggccatcggcgagggcaggtgaggcagccccattgccccttcccagaagcccctgctaccctggcctccccaacttccccaaccctcggcccccccataaaggctgactctggcgcctcccatcctagggagggaagatggctctgtgagcacagggaggtgccagggcagctcccagagctcgagagtaaccctcacctgcttccccagcctggagccgtccccacagtcccaggcagaggatggccggagccaggcggcagttggggcggtaccagagggtgcctggaaggatacggcccagctccacaagagcgaggaggcggtgagtgtcggacaggtgggttctgaaaaagtccttgcccctctctcggcctcggtttcatgatctacagtgtcagggggtgcagaacccccagcctgggtgatgtcacggccccttcagtgctgcctttctgggatccagaggagccccctcaggcttcactctcgtgcttcctgctgctgcaaatagcccgggtctcgtgagcctgtgatgcacacagccaggtcttgcgaggcctggaggcctggcag

SEQ ID NO: 301010 - DNA, 3993 bp, Homo sapiens
ctggggctagagaagcgcagtgagggtcagggtcgggggtggaggatgcttgggtgccaacccggccactgactttccatgggacattaggcaggtcccgctcttctctggacctcagctttcccatctgagcattgggcagaagggacgggtcgggtggtttctggagggctctccatagccttgatttctgccttctccagcaggggccgcctggctgtaggacagggcctgggaggggaggggactcttctgagactgagtccatacctctgtgttccaggatagttcctggcagctcttcactgtccaggtgcagactgaggccatcggcgagggcaggtgaggcagccccattgccccttcccagaagcccctgctaccctggcctccccaacttccccaaccctcggcccccccataaaggctgactctggcgcctcccatcctagggagggaagatggctctgtgagcacagggaggtgccagggcagctcccagagctcgagagtaaccctcacctgcttccccagcctggagccgtccccacagtcccaggcagaggatggccggagccaggcggcagttggggcggtaccagagggtgcctggaaggatacggcccagctccacaagagcgaggaggcggtgagtgtcggacagaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggttctgcacggcaaaagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaagacgggcaccctcactgaggacggcttagacgtgatgggggtggtgcccctgaaggggcaggcattcctgcccctggtcccagagcctcgccgcctgcctgtggggcccctgctccgagcactggccacctgccatgccctcagccggctccaggacacccccgtgggcgaccccatggacttgaagatggtggagtctactggctgggtcctggaggaagagccggctgcagactcagcatttgggacccaggtcttggcagtgatgagacctccactttgggagccccagctgcaggcaatggaggagcccccggtgccagtcagcgtcctccaccgcttccccttctcttcggctctgcagcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcagacaacgccagttatccaggctctgcgaaggacccgcatccgcgccgtcatggtgacaggggacaacctgcagacagcggtgactgtggcccggggctgtggcatggtggccccccaggagcatctgatcatcgtccacgccacccaccctgagcggggtcagcctgcctctctcgagttcctgccgatggagtcccccacagccgtgaatggcgttaaggatcctgaccaggctgcaagctacaccgtggagccagacccccgatccaggcacctggccctcagcgggcccacctttggtatcattgtgaagcacttccccaagctgctgcccaaggtcctggtccagggcactgtctttgcccgcatggcccctgagcagaagacagagctggtgtgcgagctacagaagcttcagtactgcgtgggcatgtgcggagacggcgccaatgactgtggggccctgaaggcggctgatgtcggcatctcgctgtcccaggcagaagcctcagtggtctcacccttcacctcgagcatggccagtattgagtgcgtgcccatggtcatcagggaggggcgctgttcccttgacacttcgttcagcgtcttcaagtacatggctctgtacagcctgacccagttcatctccgtcctgatcctctacacgatcaacaccaacctgggtgacctgcagttcctggccatcgacctggtcatcaccaccacagtggcagtgctcatgagccgcacggggccagcgctggtcctgggacgggtgcggccaccgggggcgctgctcagcgtgcccgtgctcagcagcctgctgctgcagatggtcctggtgaccggcgtgcagctagggggctacttcctgaccctggcccagccatggttcgtgcctctgaacaggacagtggccgcaccagacaacctgcccaactacgagaacaccgtggtcttctctctgtccagcttccagtacctcatcctggctgcagccgtgtccaagggggcgcccttccgccggccgctctacaccaatgtgcccttcctggtggccctggcgctcctgagctccgtcctggtgggccttgtcctggtccccggcctcctgcaggggccgctggcgctgaggaacatcactgacaccggcttcaagctgctgctgctgggtctggtcaccctcaacttcgtgggggccttcatgctggagagcgtgctagaccagtgcctccccgcctgcctgcgccgcctccggcccaagcgggcctccaagaagcgcttcaagcagctggaacgagagctggccgagcagccctggccgccgctgcccgccggccccctgaggtagtgcaggcccacgggcaccccagacactggaactccctgcctctgagccaccaactggacccctctccagcaacaccaccgccaccacctcccacatccctgaggttggcgactgtctacactcctcccccgagaccacccccaccctggggaagcgttgactactgtcccctaccttggaccatcccgcgtaggggtggcagcccccagctcccctcagtgctgctgtcagtgtagcaaataaagtcatgatattttcctggc

SEQ ID NO: 301011 - DNA, 2889 bp, Homo sapiens
ttcacacctggttacagagttaactgagacttagagcttgtgggacaattctacacagaactcctggtttgctggtgggagggaggggtgtggagtggtcctcacaccacgttccccaccaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggttctgcacggcaaaagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaagacgggcaccctcactgaggacggcttagacgtgatgggggtggtgcccctgaaggggcaggcattcctgcccctggtcccagagcctcgccgcctgcctgtggggcccctgctccgagcactggccacctgccatgccctcagccggctccaggacacccccgtgggcgaccccatggacttgaagatggtggagtctactggctgggtcctggaggaagagccggctgcagactcagcatttgggacccaggtcttggcagtgatgagacctccactttgggagccccagctgcaggcaatggaggagcccccggtgccagtcagcgtcctccaccgcttccccttctcttcggctctgcagcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcagacaacgccagttatccaggctctgcgaaggacccgcatccgcgccgtcatggtgacaggggacaacctgcagacagcggtgactgtggcccggggctgtggcatggtggccccccaggagcatctgatcatcgtccacgccacccaccctgagcggggtcagcctgcctctctcgagttcctgccgatggagtcccccacagccgtgaatggcgttaaggatcctgaccaggctgcaagctacaccgtggagccagacccccgatccaggcacctggccctcagcgggcccacctttggtatcattgtgaagcacttccccaagctgctgcccaaggtcctggtccagggcactgtctttgcccgcatggcccctgagcagaagacagagctggtgtgcgagctacagaagcttcagtactgcgtgggcatgtgcggagacggcgccaatgactgtggggccctgaaggcggctgatgtcggcatctcgctgtcccaggcagaagcctcagtggtctcacccttcacctcgagcatggccagtattgagtgcgtgcccatggtcatcagggaggggcgctgttcccttgacacttcgttcagcgtcttcaagtacatggctctgtacagcctgacccagttcatctccgtcctgatcctctacacgatcaacaccaacctgggtgacctgcagttcctggccatcgacctggtcatcaccaccacagtggcagtgctcatgagccgcacggggccagcgctggtcctgggacgggtgcggccaccgggggcgctgctcagcgtgcccgtgctcagcagcctgctgctgcagatggtcctggtgaccggcgtgcagctagggggctacttcctgaccctggcccagccatggttcgtgcctctgaacaggacagtggccgcaccagacaacctgcccaactacgagaacaccgtggtcttctctctgtccagcttccagtacctcatcctggctgcagccgtgtccaagggggcgcccttccgccggccgctctacaccaatgtgcccttcctggtggccctggcgctcctgagctccgtcctggtgggccttgtcctggtccccggcctcctgcaggggccgctggcgctgaggaacatcactgacaccggcttcaagctgctgctgctgggtctggtcaccctcaacttcgtgggggccttcatgctggagagcgtgctagaccagtgcctccccgcctgcctgcgccgcctccggcccaagcgggcctccaagaagcgcttcaagcagctggaacgagagctggccgagcagccctggccgccgctgcccgccggccccctgaggtagtgcaggcccacgggcaccccagacactggaactccctgcctctgagccaccaactggacccctctccagcaacaccaccgccaccacctcccacatccctgaggttggcgactgtctacactcctcccccgagaccacccccaccctggggaagcgttgactactgtcccctaccttggaccatcccgcgtaggggtggcagcccccagctcccctcagtgctgctgtcagtgtagcaaataaagtcatgatattttcctggc

SEQ ID NO: 301012 - DNA, 3949 bp, Homo sapiens
gagggactgcggcagtgtcggagccgcgccgagcctggtggcccaggtgccccgcccgcgtcagccctgctccagccccgcgctagcccagcgcccctcgccccgggccgtccggaccgcgcccccgcccagggccttgcgcacgccggggcccaggccgagggccgcagcgccggggccggcgatgagcgcgaggagccggcatgagcgcagacagcagccctctcgtgggcagcacgcccaccggttatgggaccctgacgatagggacatcaatagatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcggtgagtgtcggacagaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggttctgcacggcaaaagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaagacgggcaccctcactgaggacggcttagacgtgatgggggtggtgcccctgaaggggcaggcattcctgcccctggtcccagagcctcgccgcctgcctgtggggcccctgctccgagcactggccacctgccatgccctcagccggctccaggacacccccgtgggcgaccccatggacttgaagatggtggagtctactggctgggtcctggaggaagagccggctgcagactcagcatttgggacccaggtcttggcagtgatgagacctccactttgggagccccagctgcaggcaatgcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcagacaacgccagttatccaggctctgcgaaggacccgcatccgcgccgtcatggtgacaggggacaacctgcagacagcggtgactgtggcccggggctgtggcatggtggccccccaggagcatctgatcatcgtccacgccacccaccctgagcggggtcagcctgcctctctcgagttcctgccgatggagtcccccacagccgtgaatggcgttaaggatcctgaccaggctgcaagctacaccgtggagccagacccccgatccaggcacctggccctcagcgggcccacctttggtatcattgtgaagcacttccccaagctgctgcccaaggtcctggtccagggcactgtctttgcccgcatggcccctgagcagaagacagagctggtgtgcgagctacagaagcttcagtactgcgtgggcatgtgcggagacggcgccaatgactgtggggccctgaaggcggctgatgtcggcatctcgctgtcccaggcagaagcctcagtggtctcacccttcacctcgagcatggccagtattgagtgcgtgcccatggtcatcagggaggggcgctgttcccttgacacttcgttcagcgtcttcaagtacatggctctgtacagcctgacccagttcatctccgtcctgatcctctacacgatcaacaccaacctgggtgacctgcagttcctggccatcgacctggtcatcaccaccacagtggcagtgctcatgagccgcacggggccagcgctggtcctgggacgggtgcggccaccgggggcgctgctcagcgtgcccgtgctcagcagcctgctgctgcagatggtcctggtgaccggcgtgcagctagggggctacttcctgaccctggcccagccatggttcgtgcctctgaacaggacagtggccgcaccagacaacctgcccaactacgagaacaccgtggtcttctctctgtccagcttccagtacctcatcctggctgcagccgtgtccaagggggcgcccttccgccggccgctctacaccaatgtgcccttcctggtggccctggcgctcctgagctccgtcctggtgggccttgtcctggtccccggcctcctgcaggggccgctggcgctgaggaacatcactgacaccggcttcaagctgctgctgctgggtctggtcaccctcaacttcgtgggggccttcatgctggagagcgtgctagaccagtgcctccccgcctgcctgcgccgcctccggcccaagcgggcctccaagaagcgcttcaagcagctggaacgagagctggccgagcagccctggccgccgctgcccgccggccccctgaggtagtgcaggcccacgggcaccccagacactggaactccctgcctctgagccaccaactggacccctctccagcaacaccaccgccaccacctcccacatccctgaggttggcgactgtctacactcctcccccgagaccacccccaccctggggaagcgttgactactgtcccctaccttggaccatcccgcgtaggggtggcagcccccagctcccctcagtgctgctgtcagtgtagcaaataaagtcatgatattttcctggc

SEQ ID NO: 301013 - DNA, 3742 bp, Homo sapiens
gagggactgcggcagtgtcggagccgcgccgagcctggtggcccaggtgccccgcccgcgtcagccctgctccagccccgcgctagcccagcgcccctcgccccgggccgtccggaccgcgcccccgcccagggccttgcgcacgccggggcccaggccgagggccgcagcgccggggccggcgatgagcgcgaggagccggcatgagcgcagacagcagccctctcgtgggcagcacgcccaccggttatgggaccctgacgatagggacatcaatagatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcggtgagtgtcggacagaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggttctgcacggcaaaagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaaggtcctggaggaagagccggctgcagactcagcatttgggacccaggtcttggcagtgatgagacctccactttgggagccccagctgcaggcaatgcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcagacaacgccagttatccaggctctgcgaaggacccgcatccgcgccgtcatggtgacaggggacaacctgcagacagcggtgactgtggcccggggctgtggcatggtggccccccaggagcatctgatcatcgtccacgccacccaccctgagcggggtcagcctgcctctctcgagttcctgccgatggagtcccccacagccgtgaatggcgttaaggatcctgaccaggctgcaagctacaccgtggagccagacccccgatccaggcacctggccctcagcgggcccacctttggtatcattgtgaagcacttccccaagctgctgcccaaggtcctggtccagggcactgtctttgcccgcatggcccctgagcagaagacagagctggtgtgcgagctacagaagcttcagtactgcgtgggcatgtgcggagacggcgccaatgactgtggggccctgaaggcggctgatgtcggcatctcgctgtcccaggcagaagcctcagtggtctcacccttcacctcgagcatggccagtattgagtgcgtgcccatggtcatcagggaggggcgctgttcccttgacacttcgttcagcgtcttcaagtacatggctctgtacagcctgacccagttcatctccgtcctgatcctctacacgatcaacaccaacctgggtgacctgcagttcctggccatcgacctggtcatcaccaccacagtggcagtgctcatgagccgcacggggccagcgctggtcctgggacgggtgcggccaccgggggcgctgctcagcgtgcccgtgctcagcagcctgctgctgcagatggtcctggtgaccggcgtgcagctagggggctacttcctgaccctggcccagccatggttcgtgcctctgaacaggacagtggccgcaccagacaacctgcccaactacgagaacaccgtggtcttctctctgtccagcttccagtacctcatcctggctgcagccgtgtccaagggggcgcccttccgccggccgctctacaccaatgtgcccttcctggtggccctggcgctcctgagctccgtcctggtgggccttgtcctggtccccggcctcctgcaggggccgctggcgctgaggaacatcactgacaccggcttcaagctgctgctgctgggtctggtcaccctcaacttcgtgggggccttcatgctggagagcgtgctagaccagtgcctccccgcctgcctgcgccgcctccggcccaagcgggcctccaagaagcgcttcaagcagctggaacgagagctggccgagcagccctggccgccgctgcccgccggccccctgaggtagtgcaggcccacgggcaccccagacactggaactccctgcctctgagccaccaactggacccctctccagcaacaccaccgccaccacctcccacatccctgaggttggcgactgtctacactcctcccccgagaccacccccaccctggggaagcgttgactactgtcccctaccttggaccatcccgcgtaggggtggcagcccccagctcccctcagtgctgctgtcagtgtagcaaataaagtcatgatattttcctggc

SEQ ID NO: 301014 - DNA, 3839 bp, Homo sapiens
gagggactgcggcagtgtcggagccgcgccgagcctggtggcccaggtgccccgcccgcgtcagccctgctccagccccgcgctagcccagcgcccctcgccccgggccgtccggaccgcgcccccgcccagggccttgcgcacgccggggcccaggccgagggccgcagcgccggggccggcgatgagcgcgaggagccggcatgagcgcagacagcagccctctcgtgggcagcacgcccaccggttatgggaccctgacgatagggacatcaatagatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcggtgagtgtcggacagaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggttctgcacggcaaaagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaagacgggcaccctcactgaggacggcttagacgtgatgggggtggtgcccctgaaggggcaggcattcctgcccctggtcccagagcctcgccgcctgcctgtggggcccctgctccgagcactggccacctgccatgccctcagccggctccaggacacccccgtgggcgaccccatggacttgaagatggtggagtctactggctgggtcctggaggaagagccggctgcagactcagcatttgggacccaggtcttggcagtgatgagacctccactttgggagccccagctgcaggcaatggaggagcccccggtgccagtcagcgtcctccaccgcttccccttctcttcggctctgcagcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcagacaacgccagttatccaggctctgcgaaggacccgcatccgcgccgtcatggtgacaggggacaacctgcagacagcggtgactgtggcccggggctgtggcatggtggccccccaggagcatctgatcatcgtccacgccacccaccctgagcggggtcagcctgcctctctcgagttcctgccgatggagtcccccacagccgtgaatggcgttaaggatcctgaccaggctgcaagctacaccgtggagccagacccccgatccaggcacctggccctcagcgggcccacctttggtatcattgtgaagcacttccccaagctgctgcccaaggtcctggtccagggcactgtctttgcccgcatggcccctgagcagaagacagagctggtgtgcgagctacagaagcttcagtactgcgtgggcatgtgcggagacggcgccaatgactgtggggccctgaaggcggctgatgtcggcatctcgctgtcccaggcagaagcctcagtggtctcacccttcacctcgagcatggccagtattgagtgcgtgcccatggtcatcagggaggggcgctgttcccttgacacttcgttcagcgtcttcaagtacatggctctgtacagcctgacccagttcatctccgtcctgatcctctacacgatcaacaccaacctgggtgacctgcagttcctggccatcgacctggtcatcaccaccacagtggcagtgctcatgagccgcacggggccagcgctggtcctgggacgggtgcggccaccgggggcgctgctcagcgtgcccgtgctcagcagcctgctgctgcagatggtcctggtgaccggcgtgcagctagggggctacttcctgaccctggcccagccatggttcgtgcctctgaacaggacagtggccgcaccagacaacctgcccaactacgagaacaccgtggtcttctctctgtccagcttccagtacctcatcctggctgcagccgtgtccaagggggcgcccttccgccggccgctctacaccaatgagcgtgctagaccagtgcctccccgcctgcctgcgccgcctccggcccaagcgggcctccaagaagcgcttcaagcagctggaacgagagctggccgagcagccctggccgccgctgcccgccggccccctgaggtagtgcaggcccacgggcaccccagacactggaactccctgcctctgagccaccaactggacccctctccagcaacaccaccgccaccacctcccacatccctgaggttggcgactgtctacactcctcccccgagaccacccccaccctggggaagcgttgactactgtcccctaccttggaccatcccgcgtaggggtggcagcccccagctcccctcagtgctgctgtcagtgtagcaaataaagtcatgatattttcctggc

SEQ ID NO: 301015 - DNA, 3892 bp, Homo sapiens
gagggactgcggcagtgtcggagccgcgccgagcctggtggcccaggtgccccgcccgcgtcagccctgctccagccccgcgctagcccagcgcccctcgccccgggccgtccggaccgcgcccccgcccagggccttgcgcacgccggggcccaggccgagggccgcagcgccggggccggcgatgagcgcgaggagccggcatgagcgcagacagcagccctctcgtgggcagcacgcccaccggttatgggaccctgacgatagggacatcaatagatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcggtgagtgtcggacagaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggttctgcacggcaaaagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaagacgggcaccctcactgaggacggcttagacgtgatgggggtggtgcccctgaaggggcaggcattcctgcccctggtcccagagcctcgccgcctgcctgtggggcccctgctccgagcactggccacctgccatgccctcagccggctccaggacacccccgtgggcgaccccatggacttgaagatggtggagtctactggctgggtcctggaggaagagccggctgcagactcagcatttgggacccaggtcttggcagtgatgagacctccactttgggagccccagctgcaggcaatggaggagcccccggtgccagtcagcgtcctccaccgcttccccttctcttcggctctgcagcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcagacaacgccagttatccaggctctgcgaaggacccgcatccgcgccgtcatggtgacaggggacaacctgcagacagcggtgactgtggcccggggctgtggcatggtggccccccaggagcatctgatcatcgtccacgccacccaccctgagcggggtcagcctgcctctctcgagttcctgccgatggagtcccccacagccgtgaatggcgttaaggtcctggtccagggcactgtctttgcccgcatggcccctgagcagaagacagagctggtgtgcgagctacagaagcttcagtactgcgtgggcatgtgcggagacggcgccaatgactgtggggccctgaaggcggctgatgtcggcatctcgctgtcccaggcagaagcctcagtggtctcacccttcacctcgagcatggccagtattgagtgcgtgcccatggtcatcagggaggggcgctgttcccttgacacttcgttcagcgtcttcaagtacatggctctgtacagcctgacccagttcatctccgtcctgatcctctacacgatcaacaccaacctgggtgacctgcagttcctggccatcgacctggtcatcaccaccacagtggcagtgctcatgagccgcacggggccagcgctggtcctgggacgggtgcggccaccgggggcgctgctcagcgtgcccgtgctcagcagcctgctgctgcagatggtcctggtgaccggcgtgcagctagggggctacttcctgaccctggcccagccatggttcgtgcctctgaacaggacagtggccgcaccagacaacctgcccaactacgagaacaccgtggtcttctctctgtccagcttccagtacctcatcctggctgcagccgtgtccaagggggcgcccttccgccggccgctctacaccaatgtgcccttcctggtggccctggcgctcctgagctccgtcctggtgggccttgtcctggtccccggcctcctgcaggggccgctggcgctgaggaacatcactgacaccggcttcaagctgctgctgctgggtctggtcaccctcaacttcgtgggggccttcatgctggagagcgtgctagaccagtgcctccccgcctgcctgcgccgcctccggcccaagcgggcctccaagaagcgcttcaagcagctggaacgagagctggccgagcagccctggccgccgctgcccgccggccccctgaggtagtgcaggcccacgggcaccccagacactggaactccctgcctctgagccaccaactggacccctctccagcaacaccaccgccaccacctcccacatccctgaggttggcgactgtctacactcctcccccgagaccacccccaccctggggaagcgttgactactgtcccctaccttggaccatcccgcgtaggggtggcagcccccagctcccctcagtgctgctgtcagtgtagcaaataaagtcatgatattttcctggc

SEQ ID NO: 301016 - DNA, 3957 bp, Homo sapiens
gagggactgcggcagtgtcggagccgcgccgagcctggtggcccaggtgccccgcccgcgtcagccctgctccagccccgcgctagcccagcgcccctcgccccgggccgtccggaccgcgcccccgcccagggccttgcgcacgccggggcccaggccgagggccgcagcgccggggccggcgatgagcgcgaggagccggcatgagcgcagacagcagccctctcgtgggcagcacgcccaccggttatgggaccctgacgatagggacatcaatagatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcggtgagtgtcggacagaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggttctgcacggcaaaagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaagacgggcaccctcactgaggacggcttagacgtgatgggggtggtgcccctgaaggggcaggcattcctgcccctggtcccagagcctcgccgcctgcctgtggggcccctgctccgagcactggccacctgccatgccctcagccggctccaggacacccccgtgggcgaccccatggacttgaagatggtggagtctactggctgggtcctggaggaagagccggctgcagactcagcatttgggacccaggtcttggcagtgatgagacctccactttgggagccccagctgcaggcaatggaggagcccccggtgccagtcagcgtcctccaccgcttccccttctcttcggctctgcagcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcagacaacgccagttatccaggctctgcgaaggacccgcatccgcgccgtcatggtgacaggggacaacctgcagacagcggtgactgtggcccggggctgtggcatggtggccccccaggagcatctgatcatcgtccacgccacccaccctgagcggggtcagcctgcctctctcgagttcctgccgatggagtcccccacagccgtgaatggcgttaaggatcctgaccaggctgcaagctacaccgtggagccagacccccgatccaggcacctggccctcagcgggcccacctttggtatcattgtgaagcacttccccaagctgctgcccaaggtcctggtccagggcactgtctttgcccgcatggcccctgagcagaagacagagctggtgtgcgagctacagaagcttcagtactgcgtgggcatgtgcggagacggcgccaatgactgtggggccctgaaggcggctgatgtcggcatctcgctgtcccaggcagaagcctcagtggtctcacccttcacctcgagcatggccagtattgagtgcgtgcccatggtcatcagggaggggcgctgttcccttgacacttcgttcagcgtcttcaagtacatggctctgtacagcctgacccagttcatctccgtcctgatcctctacacgatcaacaccaacctgggtgacctgcagttcctggccatcgactggtcctgggacgggtgcggccaccgggggcgctgctcagcgtgcccgtgctcagcagcctgctgctgcagatggtcctggtgaccggcgtgcagctagggggctacttcctgaccctggcccagccatggttcgtgcctctgaacaggacagtggccgcaccagacaacctgcccaactacgagaacaccgtggtcttctctctgtccagcttccagtacctcatcctggctgcagccgtgtccaagggggcgcccttccgccggccgctctacaccaatgtgcccttcctggtggccctggcgctcctgagctccgtcctggtgggccttgtcctggtccccggcctcctgcaggggccgctggcgctgaggaacatcactgacaccggcttcaagctgctgctgctgggtctggtcaccctcaacttcgtgggggccttcatgctggagagcgtgctagaccagtgcctccccgcctgcctgcgccgcctccggcccaagcgggcctccaagaagcgcttcaagcagctggaacgagagctggccgagcagccctggccgccgctgcccgccggccccctgaggtagtgcaggcccacgggcaccccagacactggaactccctgcctctgagccaccaactggacccctctccagcaacaccaccgccaccacctcccacatccctgaggttggcgactgtctacactcctcccccgagaccacccccaccctggggaagcgttgactactgtcccctaccttggaccatcccgcgtaggggtggcagcccccagctcccctcagtgctgctgtcagtgtagcaaataaagtcatgatattttcctggc

SEQ ID NO: 301017 - DNA, 3536 bp, Homo sapiens
gagggactgcggcagtgtcggagccgcgccgagcctggtggcccaggtgccccgcccgcgtcagccctgctccagccccgcgctagcccagcgcccctcgccccgggccgtccggaccgcgcccccgcccagggccttgcgcacgccggggcccaggccgagggccgcagcgccggggccggcgatgagcgcgaggagccggcatgagcgcagacagcagccctctcgtgggcagcacgcccaccggttatgggaccctgacgatagggacatcaatagatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcggtgagtgtcggacagaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggttctgcacggcaaaagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaagacgggcaccctcactgaggacggcttagacgtgatgggggtggtgcccctgaaggggcaggcattcctgcccctggtcccagagcctcgccgcctgcctgtggggcccctgctccgagcactggccacctgccatgccctcagccggctccaggacacccccgtgggcgaccccatggacttgaagatggtggagtctactggctgggtcctggaggaagagccggctgcagactcagcatttgggacccaggtcttggcagtgatgagacctccactttgggagccccagctgcaggcaatggaggagcccccggtgccagtcagcgtcctccaccgcttccccttctcttcggctctgcagcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcagacaacgccagttatccaggctctgcgaaggacccgcatccgcgccgtcatggtgacaggggacaacctgcagacagcggtgactgtggcccggggctgtggcatggtggccccccaggagcatctgatcatcgtccacgccacccaccctgagcggggtcagcctgcctctctcgagttcctgccgatggagtcccccacagccgtgaatggcgttaaggatcctgaccaggctgcaagctacaccgtggagccagacccccgatccaggcacctggccctcagcgggcccacctttggtatcattgtgaagcacttccccaagctgctgcccaaggtcctggtccagggcactgtctttgcccgcatggcccctgagcagaagacagagctggtgtgcgagctacagaagcttcagtactgcgtgggcatgtgcggagacggcgccaatgactgtggggccctgaaggcggctgatgtcggcatctcgctgtcccaggcagaagcctcagtggtctcacccttcacctcgagcatggccagtattgagtgcgtgcccatggtcatcagggaggggcgctgttcccttgacacttcgttcagcgtcttcaagtacatggctctgtacagcctgacccagttcatctccgtcctgatcctctacacgatcaacaccaacctgggtgacctgcagttcctggccatcgacctggtcatcaccaccacagtggcagtgctcatgagccgcacggggccagcgctggtcctgggacgggtgcggccaccgggggcgctgctcagcgtgcccgtgctcagcagcctgctgctgcagatggtcctggtgaccggcgtgcagctagggggctacttcctgaccctggcccagccatggttcgtgcctctgaacaggacagtggccgcaccagacaacctgcccaactacgagaacaccgtggtcttctctctgtccagcttccagtacctcatcctggctgcagccgtgtccaagggggcgcccttccgccggccgctctacaccaatggtgccactgcgggcgcgggcgggagatgctggcggagggagggaggagccctggggtgctggggaggcagatgggagagaggtgccggccgagtggaa

SEQ ID NO: 301018 - DNA, 2718 bp, Homo sapiens
gagggactgcggcagtgtcggagccgcgccgagcctggtggcccaggtgccccgcccgcgtcagccctgctccagccccgcgctagcccagcgcccctcgccccgggccgtccggaccgcgcccccgcccagggccttgcgcacgccggggcccaggccgagggccgcagcgccggggccggcgatgagcgcgaggagccggcatgagcgcagacagcagccctctcgtgggcagcacgcccaccggttatgggaccctgacgatagggacatcaatagatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcggtgagtgtcggacagaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggttctgcacggcaaaagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaagacgggcaccctcactgaggacggcttagacgtgatgggggtggtgcccctgaaggggcaggcattcctgcccctggtcccagagcctcgccgcctgcctgtggggcccctgctccgagcactggccacctgccatgccctcagccggctccaggacacccccgtgggcgaccccatggacttgaagatggtggagtctactggctgggtcctggaggaagagccggctgcagactcagcatttgggacccaggtcttggcagtgatgagacctccactttgggagccccagctgcaggcaatggaggagcccccggtgccagtcagcgtcctccaccgcttccccttctcttcggctctgcagcgcatgagtgtggtggtggcgtggccaggggccactcagcccgaggcctacgtcaaaggctccccggagctggtggcagggctctgcaaccccgagacagtgcccaccgacttcgcccagatgctgcagagctatacagctgctggctaccgtgtcgtggccctggccagcaagccactgcccactgtgcccagcctggaggcagcccagcaactgacgagggacactgtggaaggagacctgagcctcctggggctgctggtcatgaggaacctactgaagccgcagacaacgccagttatccaggctctgcgaaggacccgcatccgcgccgtcatggtgacaggggacaacctgcagacagcggtgactgtggcccggggctgtggcatggtggccccccaggagcatctgatcatcgtccacgccaccacctcccacatccctgaggttggcgactgtctacactcctcccccgagaccacccccaccctggggaagcgttgactactgtcccctaccttggaccatcccgcgtaggggtggcagcccccagctcccctcagtgctgctgtcagtgtagcaaataaagtcatgatattttcctggc

SEQ ID NO: 301019 - DNA, 2054 bp, Homo sapiens
gagggactgcggcagtgtcggagccgcgccgagcctggtggcccaggtgccccgcccgcgtcagccctgctccagccccgcgctagcccagcgcccctcgccccgggccgtccggaccgcgcccccgcccagggccttgcgcacgccggggcccaggccgagggccgcagcgccggggccggcgatgagcgcgaggagccggcatgagcgcagacagcagccctctcgtgggcagcacgcccaccggttatgggaccctgacgatagggacatcaatagatcccctcagctcctcagtttcatccgtgaggctcagcggctactgtggcagtccatggagggtcatcggctatcacgtcgtggtctggatgatggctgggatccctttgctgctcttccgttggaagcccctgtggggggtgcggctgcggctccggccctgcaacctggcccacgccgaaacactcgttatcgaaataagagacaaagaggatagttcctggcagctcttcactgtccaggtgcagactgaggccatcggcgagggcagcctggagccgtccccacagtcccaggcagaggatggccggagccaggcggcagttggggcggtaccagagggtgcctggaaggatacggcccagctccacaagagcgaggaggcggtgagtgtcggacagaagcgggtgctgcggtattacctcttccagggccagcgctatatctggatcgagacccagcaagccttctaccaggtcagcctcctggaccatggccgctcttgtgacgacgtccaccgctcccgccatggcctcagcctccaggaccaaatggtgaggaaggccatttacggccccaacgtgatcagcataccggtcaagtcctacccccagctgctggtggacgaggcactgaacccctactatgggttccaggccttcagcatcgcgctgtggctggctgaccactactactggtacgccctgtgcatcttcctcatttcctccatctccatctgcctgtcgctgtacaagaccagaaagcaaagccagactctaagggacatggtcaagttgtccatgcgggtgtgcgtgtgccggccagggggagaggaagagtgggtggactccagtgagctagtgcccggagactgcctggtgctgccccaggagggtgggctgatgccctgtgatgccgccctggtggccggcgagtgcatggtgaatgagagctctctgacaggagagagcattccagtgctgaagacggcactgccggaggggctggggccctactgtgcagagacacaccggcggcacacactcttctgcgggaccctcatcttgcaggcccgggcctatgtgggaccgcacgtcctggcagtggtgacccgcacagggttctgcacggcaaaagggggcctggtgagctccatcttgcacccccggcccatcaacttcaagttctataaacacagcatgaagtttgtggctgccctctctgtcctggctctcctcggcaccatctacagcatcttcatcctctaccgaaaccgggtgcctctgaatgagattgtaatccgggctctcgacctggtgaccgtggtggtgccacctgccctgcctgctgccatgactgtgtgcacgctctacgcccagagccgactgcggagacagggcattttctgcatccacccactgcgcatcaacctggggggcaagctgcagctggtgtgtttcgacaaggtggggccgcaggtggggttggtgcaggggagcgggacagccacaggcgccccagtgaggcctccacacccgcgttattctctcagcagcacccacaggatgccaggtcctgtctagggatggaaacccccagaggatccaccccatcccactcctgccctcactgggctcacggtctggcagatgaaatgtctagaatcatgtattcatgtgttcaagaactggtggggggccgggcgcggtggctcacgtctgtaatcccagcactttgggaggctgaggcagatacatcacttgaggtcaggagtt

SEQ ID NO: 301020 - DNA, 671 bp, Homo sapiens
tatcactaaataacagctactcttttcactgttcatattattagcatcatctctcgctgttctccttcttcagtgacttggtttggaacccagtgagaggaacaaaagggcaaagccaagccttgggttcaagggggcttacttgctcccaggagctcagtgtggcagaacggggatggggggcctagagcccatagtctccagcctgcacagggtgggggatgcagacctcaggccccatggcccatgcgtgtcccctcgcacccacccccagcctcctggaccatggccgctcttgtgacgacgtccaccgctcccgccatggcctcagcctccaggaccaaatggtgaggtcagtgctgccctggaccggggtgccctgagaactggggctccttgtgttgccccccaatgtggttgccttccagtcacctgccttctctgggcctcagttcccccagctgaaagtggggagctccttcaccccgggagggtccagccacagctcctccttctgatggcttggcctcatcccctcttccaggaaggccatttacggccccaacgtgatcagcataccggtcaagtcctacccccagctgctggtggacgaggtagggctgtccctgggtcttgccccagccctgcctggcgtgctgtgtgaccttggc

SEQ ID NO: 301021 - DNA, 155 bp, Homo sapiens
tggtcctgggacgggtgcggccaccgggggcgctgctcagcgtgcccgtgctcagcagcctgctgctgcagatggtcctggtgaccggcgtgcagctagggggctacttcctgaccctggcccagccatggtgagtagggagctgactgaccacc

SEQ ID NO: 301022 - DNA, 2285 bp, Homo sapiens
  misc_feature (1)..(1): n is a, c, g, or t
  misc_feature (18)..(18): n is a, c, g, or t
  misc_feature (20)..(20): n is a, c, g, or t
nggtccggaattcccggnangccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301023 - DNA, 2082 bp, Homo sapiens
ctgctggctgactcttgaggatcccggctccggtgtactgcgtggtcctttcctgtacgagcctgtgcgctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301024 - DNA, 295 bp, Homo sapiens
ggaagccagggttcaggcaggcccaggctccagccatctcatcgccagcctcctcctggacctcttggcccccctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301025 - DNA, 220 bp, Homo sapiens
  misc_feature (196)..(196): n is a, c, g, or t
  misc_feature (202)..(202): n is a, c, g, or t
aggggctgctatgtctgtccttgttgcctcaggacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaaggccagcctcttcctgnaagccncgtgctccgataaacgac

SEQ ID NO: 301026 - DNA, 794 bp, Homo sapiens
ggataagtgggcgtggtctaggggggaagtcaccaagaacgcaccggaggtccttgcccgccctggaaaacgccctctgcggtgaaggagagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctgtgaggaccccatttgtgcccat

SEQ ID NO: 301027 - DNA, 404 bp, Homo sapiens
taggcactacatgttagtttttattatggttattattgtaagcatcagactcagtcgtgggatcacctcctccaggaagccttccctgattgccccaggttcaagctgtcttctgggcttccctagtgctgtccgtgacttctttggatcatgtctggcccaagatgggggttctgaaagaacatgccctcaggtgttggactcttccctctcttccagatgtacaggtggatcatctgaatctcctgacttgccatcctcttcccttcagatatcaacagtgatggtgtcctggatgagcaggagctggaggcactcttcaccaaggagtgagcatcttggaagcctcgggcacctggagggacgcccaaatcagccacttgtttcctcctgcagtcccctta

SEQ ID NO: 301028 - DNA, 537 bp, Homo sapiens
ctggcctggttgtctgggaggcagaggtccctgataaccctggagctgactctgtgtccagagcactgaatgccagggccagagaatcctgcatgacagtgacccaagcatgtttcctcgaaccctccctttgatctattccattctcaaccccctggtcgctaggcagtggccctagcaacgggtctagtggggtagctaaagcctgggggccaccgttccaccgcgggagacccgtagttacctgtcctctgataacagaccccacatcagcccaaaatttcttcaccagggaccttacacatcccgtcctcggtcccctgagataccttgccatcctcttcccttcagatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtgaggtgggggccaggcgggggagaggacgggc

SEQ ID NO: 301029 - DNA, 2298 bp, Homo sapiens
  misc_feature (28)..(28): n is a, c, g, or t
tgcaggctggtactggcctgggatgtanggatcgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301030 - DNA, 2287 bp, Homo sapiens
  misc_feature (15)..(15): n is a, c, g, or t
gcggctgtacgcccngcgggttatgggatgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301031 - DNA, 2533 bp, Homo sapiens
  misc_feature (28)..(28): n is a, c, g, or t
  misc_feature (2323)..(2323): n is a, c, g, or t
tgcaggctggtactggcctgggatgtanggatcgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaaaaaaaacaaaacaaaaaaaaaacancaaagaacagaaagaccctaccgtcatcccgcaggggagaacaaaagaagctggccgacgacaggaacaccggcggacacaggtagaaggatacgccccctccacccccggcgtgccgcgcccaaggcagaaccagatggaacatcacggggaccgacgcgctcgcgaaaacagggcagggggaccctcagcgaggaacaacggggacac

SEQ ID NO: 301032 - DNA, 2275 bp, Homo sapiens
  misc_feature (16)..(16): n is a, c, g, or t
  misc_feature (21)..(21): n is a, c, g, or t
gtgtcctggtacggcnggaantagggatgagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301033 - DNA, 2513 bp, Homo sapiens
  misc_feature (28)..(28): n is a, c, g, or t
  misc_feature (2304)..(2304): n is a, c, g, or t
  misc_feature (2306)..(2306): n is a, c, g, or t
tgcaggctggtactggcctgggatgtanggatcgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaaaaaaananacacaaaacaccaacaacggcggggggcttaaaattcccgagggcgcccaattcccgtcccccttttttgaacagggcccccagaggacgtaaaacaaagaaggcccgtttaaccgtcgcggggaaagcctcgcattgaaggacccctctgccggaatggcacccacaatagcccaaaaactatgtagttacgcttcgcagagtata

SEQ ID NO: 301034 - DNA, 2700 bp, Homo sapiens
  misc_feature (28)..(28): n is a, c, g, or t
  misc_feature (2306)..(2306): n is a, c, g, or t
  misc_feature (2308)..(2308): n is a, c, g, or t
tgcaggctggtactggcctgggatgtanggatcgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaaaaacaaananaacaacacaacacaaaaacaaaacacacaaaccaaaaaacacaaacacaaaacaacacacacacccacaccaaccacaacacacaccacaacaacaaaacctaacgctggaccgcgggggcggcccgcccccaccgcccgccaaccaccccgcagccgcgccacctcctcgccccacccgcccgccccccactcccgcgacacgcgccagccccccacaccaagagacgcgccaaagcaccacaccccgcgcgcccgacccccccccaacacccacggccccacgcaccgccacacccccacccacgccccaccccccgcagacaccccacaccaccccgcgcccgaccaccgcagcccacacccccgcaccgcacccacccacgcaaccca

SEQ ID NO: 301035 - DNA, 2519 bp, Homo sapiens
  misc_feature (28)..(28): n is a, c, g, or t
tgcaggctggtactggcctgggatgtanggatcgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaacaaaaaaagacacagagaagagaagacgaaaagaacacaaaagaaatgaaagactagcagaatccgagagacgaagaaaatacacatatgaccgggacacctgcataacacccggagcccctgcgggcgctccgtacacgcgaagaggccggcccagcgcgcgttcccgctccctagatgtcgttgcgtgtgaagggaccttgcatcccaactcgccgacg

SEQ ID NO: 301036 - DNA, 2324 bp, Homo sapiens
  misc_feature (28)..(28): n is a, c, g, or t
  misc_feature (2242)..(2242): n is a, c, g, or t
  misc_feature (2251)..(2251): n is a, c, g, or t
  misc_feature (2291)..(2292): n is a, c, g, or t
tgcaggctggtactggcctgggatgtanggatcgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatgncttgattgntgttacccacaattttaacaacgccaccggtggtggcccnnggtttccaaagtcctcaaaataccacttttac

SEQ ID NO: 301037 - DNA, 2832 bp, Homo sapiens
  misc_feature (28)..(28): n is a, c, g, or t
  misc_feature (2283)..(2283): n is a, c, g, or t
  misc_feature (2310)..(2310): n is a, c, g, or t
  misc_feature (2430)..(2431): n is a, c, g, or t
  misc_feature (2475)..(2475): n is a, c, g, or t
tgcaggctggtactggcctgggatgtanggatcgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcagggagatggaggaggagcgactgcgcatgcgggagcatgtgatgaagaatgtggacaccaaccaggaccgcctcgtgaccctggaggagttnctcgcatccactcagaggaaggagttnggggacaccggggagggctgggagacagtggagatgcaccctgcctacaccgaggaagagctgaggcgctttgaagaggagctggctgcccgggaggcagagctgaatgccaaggcccanngcctcagccaggagacagaggctctagggcggtcccagggccgnctggaggcccacaagagagagctgcagcaggctgagctgcacatggagcagcggaagcatcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301038 - DNA, 2884 bp, Homo sapiens
  misc_feature (28)..(28): n is a, c, g, or t
  misc_feature (2283)..(2283): n is a, c, g, or t
  misc_feature (2310)..(2310): n is a, c, g, or t
  misc_feature (2430)..(2431): n is a, c, g, or t
  misc_feature (2475)..(2475): n is a, c, g, or t
tgcaggctggtactggcctgggatgtanggatcgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcagggagatggaggaggagcgactgcgcatgcgggagcatgtgatgaagaatgtggacaccaaccaggaccgcctcgtgaccctggaggagttnctcgcatccactcagaggaaggagttnggggacaccggggagggctgggagacagtggagatgcaccctgcctacaccgaggaagagctgaggcgctttgaagaggagctggctgcccgggaggcagagctgaatgccaaggcccanngcctcagccaggagacagaggctctagggcggtcccagggccgnctggaggcccacaagagagagctgcagcaggctgagctgcacatggagcagcggaagcatcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaaaaagatattagccgtacttaagaattcaaaaagttctacaggttgaaatatc

SEQ ID NO: 301039 - DNA, 2096 bp, Homo sapiens
  misc_feature (28)..(28): n is a, c, g, or t
tgcaggctggtactggcctgggatgtanggatcgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgaccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301040 - DNA, 2465 bp, Homo sapiens
  misc_feature (28)..(28): n is a, c, g, or t
tgcaggctggtactggcctgggatgtanggatcgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgaccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaaaaaaagaaaaaaaaaaaaaaaaagagggaaaaaaaaaaaagaaaaaaaaaaaaaaaaaagagtgtgtgggggggcgggggggaaaaaaagggggcccgggaaaaaatttttaaaaacatgtgggggggggggggggaccccagttgatgtgctaggccacaagttgggctaaaagcggtgtgtctcgaaaagaaacactcgcggggccacgagcacaaggcgggggggtttcctcccaaaataaaaaaggccgggggggaacacgcggcggtttcgcgaacacctccgagggggccctccgaggcgcacacgggggctctacacagcgggtccacagggcgcacacattaaaattacccgcacgggggg

SEQ ID NO: 301041 - DNA, 2120 bp, Homo sapiens
  misc_feature (28)..(28): n is a, c, g, or t
tgcaggctggtactggcctgggatgtanggatcgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggagaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301042 - DNA, 1875 bp, Homo sapiens
  misc_feature (28)..(28): n is a, c, g, or t
tgcaggctggtactggcctgggatgtanggatcgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaaccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301043 - DNA, 1794 bp, Homo sapiens
  misc_feature (15)..(15): n is a, c, g, or t
gcggctgtacgcccngcgggttatgggatgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatctgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301044 - DNA, 1407 bp, Homo sapiens
  misc_feature (28)..(28): n is a, c, g, or t
tgcaggctggtactggcctgggatgtanggatcgccctctgcggtgaaggagagaccacactgccatgcctccctctgggccccgaggaaccctccttctgttgccgctgctgctgctgctcctgcttcgatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301045 - DNA, 1760 bp, Homo sapiens
  misc_feature (15)..(15): n is a, c, g, or t
gcggctgtacgcccngcgggttatgggatgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtccctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301046 - DNA, 2138 bp, Homo sapiens
  misc_feature (15)..(15): n is a, c, g, or t
gcggctgtacgcccngcgggttatgggatgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagccacccgggaccttgcccagtacgacgcagcccatcatgaagagttcaagcgctacgagatgcttaaggaacacgagagacggcgttatctggagtcactgggagaggagcagagaaatgaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggagccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301047 - DNA, 1662 bp, Homo sapiens
  misc_feature (15)..(15): n is a, c, g, or t
gcggctgtacgcccngcgggttatgggatgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacaccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301048 - DNA, 1554 bp, Homo sapiens
  misc_feature (15)..(15): n is a, c, g, or t
gcggctgtacgcccngcgggttatgggatgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301049 - DNA, 1351 bp, Homo sapiens
  misc_feature (15)..(15): n is a, c, g, or t
gcggctgtacgcccngcgggttatgggatgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301050 - DNA, 1206 bp, Homo sapiens
  misc_feature (15)..(15): n is a, c, g, or t
gcggctgtacgcccngcgggttatgggatgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301051 - DNA, 1069 bp, Homo sapiens
  misc_feature (9)..(9): n is a, c, g, or t
  misc_feature (71)..(71): n is a, c, g, or t
  misc_feature (88)..(88): n is a, c, g, or t
  misc_feature (93)..(93): n is a, c, g, or t
acacttcancaaccttctctcaaaatccacaaccccaacaacaacaaccacaacaacaaaccaaaaaccanccccctcaccaccttcnccccncttcaagtccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301052 - DNA, 1113 bp, Homo sapiens
  misc_feature (15)..(15): n is a, c, g, or t
gcggctgtacgcccngcgggttatgggatgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301053 - DNA, 1020 bp, Homo sapiens
  misc_feature (15)..(15): n is a, c, g, or t
gcggctgtacgcccngcgggttatgggatgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301054 - DNA, 1210 bp, Homo sapiens
  misc_feature (28)..(28): n is a, c, g, or t
tgcaggctggtactggcctgggatgtanggatcgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301055 - DNA, 1571 bp, Homo sapiens
  misc_feature (1)..(1): n is a, c, g, or t
  misc_feature (18)..(18): n is a, c, g, or t
  misc_feature (20)..(20): n is a, c, g, or t
nggtccggaattcccggnangccctctgcggtgaaggagagaccacaaggccccggctgcccaccctgaggggcagctcaagtccacccagacacagacgatgtacctgtcccagctccagccggtgaccagaaggaggtggacacttcagaaaagaaacttctcgagcggctccctgaggttgaggtgccccagcatctgtgatcctccgggaccccagcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301056 - DNA, 881 bp, Homo sapiens
  misc_feature (28)..(28): n is a, c, g, or t
tgcaggctggtactggcctgggatgtanggatcgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgtcctgctgtgtgtcctgttccatgttccggttccatccaaatacactttctggaacaaa

SEQ ID NO: 301057 - DNA, 911 bp, Homo sapiens
  misc_feature (28)..(28): n is a, c, g, or t
tgcaggctggtactggcctgggatgtanggatcgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtggccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301058 - DNA, 983 bp, Homo sapiens
  misc_feature (28)..(28): n is a, c, g, or t
tgcaggctggtactggcctgggatgtanggatcgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301059 - DNA, 496 bp, Homo sapiens
  misc_feature (28)..(28): n is a, c, g, or t
tgcaggctggtactggcctgggatgtanggatcgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 301060 - DNA, 223 bp, Homo sapiens
tgggatccctgattccagaccatgactcctggacagcatttctggagctccctttggccagaggggagcatagtacccttaagggagtaactcaggactggcagcactcatgacaagctgactgaagggcccgtggaccttgagtaacattggtggtaaccaggtagtatttatcatggtcctgggtcactggtggccatggggagatactgctctactcgag

SEQ ID NO: 301061 - DNA, 1718 bp, Homo sapiens
ctggggcccccagagagggtggggagatgacacagttgttcccccagccctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacaggccgtgacccgccctacgctgcccgacccgcacctctcgcacccgcagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacggggtaagtgggtgcacgtgggaagctgtggggagaagcagggtcgctgctgcttctagggtggggagcggcaccccagttatgttggcaggtccctgcccctgctaatgcctctgctttgcctcttgcagaagcacaatggtggggttgagctccgggctgagtccagccctcatgagcaacaaccctttggccactatccaaggtgcgtgctgcctcatgtcacacccatcgtcaccagccccggaattcgag

SEQ ID NO: 301062 - DNA, 4486 bp, Homo sapiens
cgtcaacatgagttgggcctggggcagatgaggctggctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacgggccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatatataaaagggaaagaagatgaggactcttcaagaataagatggaaccgcgaggcggagccaagcccctgcaccggtggtccaggcccttgttccccaaggcggatggaaggacggatgcttctttctcttcacaaatacctcatggacgttgtctttgggaaagccggagggggcggctggggcagggcctgtccctcggccagggcagatggaagcgggtgggcggggctgagagagggtatcagggacaggggtgaagagccccaaactcccctcccaaatcaactgaaaaagctttaaaaaaagacaggaaaaaaaggagtaagaaagcaaaaagaacagatgaaggaaaacttaacaacttttgggtggtttgattcctcctttgatttctttttcggttctcttttgtctgacctctctcctcccctccttcctctctcctcccctccttcctctctcctctcctccttcctgtctcctctctctccctttgctctcctctcttctctctcaatcttgttctttctgtgtctctcctcaaaccaaagtgttgcagtgaaggacacgagccattgaaatcagggtggggcctgacagccgtagtgtggcccctgccccttgttgggcaggagcagagagagaggagagccctgagaccgcagggctttggcctgggcagcttccactttctgccggacactctgaggagaggcagatggagctccaggcctcagcgttctcttttttccttgtctcccttctcccacccgggaaatgaaactgttgggctgggcgacggaggcagcagagactcggccattgcaggggcctctgggtgccttgtccgggcagtggtgaagtagccgcccctcccaccccggcacgatggggcctggcacctcgtctacccaacctcaccggaatgtaagcatctccgctgaacgactccctgcccttaccctacctctgagtttgtccatgtttatttcctgaagagagaagggactggcaagagggcttgggccccagcccaagggtggagagggggccaagggctcctgaccaaataggaaggacatttgagcagagcaaaatgaaaggaattacaaccaaaaaccccctccgagaagacaggcagcatggaaggcatggtggagatgactcaaacaaaaactatgattctagaccaaaaaggaa

SEQ ID NO: 301063 - DNA, 4534 bp, Homo sapiens
cgtcaacatgagttgggcctggggcagatgaggctggctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacaggccgtgacccgccctacgctgcccgacccgcacctctcgcacccgcagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacgggccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatatataaaagggaaagaagatgaggactcttcaagaataagatggaaccgcgaggcggagccaagcccctgcaccggtggtccaggcccttgttccccaaggcggatggaaggacggatgcttctttctcttcacaaatacctcatggacgttgtctttgggaaagccggagggggcggctggggcagggcctgtccctcggccagggcagatggaagcgggtgggcggggctgagagagggtatcagggacaggggtgaagagccccaaactcccctcccaaatcaactgaaaaagctttaaaaaaagacaggaaaaaaaggagtaagaaagcaaaaagaacagatgaaggaaaacttaacaacttttgggtggtttgattcctcctttgatttctttttcggttctcttttgtctgacctctctcctcccctccttcctctctcctcccctccttcctctctcctctcctccttcctgtctcctctctctccctttgctctcctctcttctctctcaatcttgttctttctgtgtctctcctcaaaccaaagtgttgcagtgaaggacacgagccattgaaatcagggtggggcctgacagccgtagtgtggcccctgccccttgttgggcaggagcagagagagaggagagccctgagaccgcagggctttggcctgggcagcttccactttctgccggacactctgaggagaggcagatggagctccaggcctcagcgttctcttttttccttgtctcccttctcccacccgggaaatgaaactgttgggctgggcgacggaggcagcagagactcggccattgcaggggcctctgggtgccttgtccgggcagtggtgaagtagccgcccctcccaccccggcacgatggggcctggcacctcgtctacccaacctcaccggaatgtaagcatctccgctgaacgactccctgcccttaccctacctctgagtttgtccatgtttatttcctgaagagagaagggactggcaagagggcttgggccccagcccaagggtggagagggggccaagggctcctgaccaaataggaaggacatttgagcagagcaaaatgaaaggaattacaaccaaaaaccccctccgagaagacaggcagcatggaaggcatggtggagatgactcaaacaaaaactatgattctagaccaaaaaggaa

SEQ ID NO: 301064 - DNA, 4552 bp, Homo sapiens
cgtcaacatgagttgggcctggggcagatgaggctggctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaaggtgggcattctctctggcctccacttaacattctggggtcccggaccctgcctctctcccccccagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacgggccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatatataaaagggaaagaagatgaggactcttcaagaataagatggaaccgcgaggcggagccaagcccctgcaccggtggtccaggcccttgttccccaaggcggatggaaggacggatgcttctttctcttcacaaatacctcatggacgttgtctttgggaaagccggagggggcggctggggcagggcctgtccctcggccagggcagatggaagcgggtgggcggggctgagagagggtatcagggacaggggtgaagagccccaaactcccctcccaaatcaactgaaaaagctttaaaaaaagacaggaaaaaaaggagtaagaaagcaaaaagaacagatgaaggaaaacttaacaacttttgggtggtttgattcctcctttgatttctttttcggttctcttttgtctgacctctctcctcccctccttcctctctcctcccctccttcctctctcctctcctccttcctgtctcctctctctccctttgctctcctctcttctctctcaatcttgttctttctgtgtctctcctcaaaccaaagtgttgcagtgaaggacacgagccattgaaatcagggtggggcctgacagccgtagtgtggcccctgccccttgttgggcaggagcagagagagaggagagccctgagaccgcagggctttggcctgggcagcttccactttctgccggacactctgaggagaggcagatggagctccaggcctcagcgttctcttttttccttgtctcccttctcccacccgggaaatgaaactgttgggctgggcgacggaggcagcagagactcggccattgcaggggcctctgggtgccttgtccgggcagtggtgaagtagccgcccctcccaccccggcacgatggggcctggcacctcgtctacccaacctcaccggaatgtaagcatctccgctgaacgactccctgcccttaccctacctctgagtttgtccatgtttatttcctgaagagagaagggactggcaagagggcttgggccccagcccaagggtggagagggggccaagggctcctgaccaaataggaaggacatttgagcagagcaaaatgaaaggaattacaaccaaaaaccccctccgagaagacaggcagcatggaaggcatggtggagatgactcaaacaaaaactatgattctagaccaaaaaggaa

SEQ ID NO: 301065 - DNA, 4700 bp, Homo sapiens
ctggggcccccagagagggtggggagatgacacagttgttcccccagccctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacggggtaagtgggtgcacgtgggaagctgtggggagaagcagggtcgctgctgcttctagggtggggagcggcaccccagttatgttggcaggtccctgcccctgctaatgcctctgctttgcctcttgcagaagcacaatggtggggttgagctccgggctgagtccagccctcatgagcaacaaccctttggccactatccaagccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatatataaaagggaaagaagatgaggactcttcaagaataagatggaaccgcgaggcggagccaagcccctgcaccggtggtccaggcccttgttccccaaggcggatggaaggacggatgcttctttctcttcacaaatacctcatggacgttgtctttgggaaagccggagggggcggctggggcagggcctgtccctcggccagggcagatggaagcgggtgggcggggctgagagagggtatcagggacaggggtgaagagccccaaactcccctcccaaatcaactgaaaaagctttaaaaaaagacaggaaaaaaaggagtaagaaagcaaaaagaacagatgaaggaaaacttaacaacttttgggtggtttgattcctcctttgatttctttttcggttctcttttgtctgacctctctcctcccctccttcctctctcctcccctccttcctctctcctctcctccttcctgtctcctctctctccctttgctctcctctcttctctctcaatcttgttctttctgtgtctctcctcaaaccaaagtgttgcagtgaaggacacgagccattgaaatcagggtggggcctgacagccgtagtgtggcccctgccccttgttgggcaggagcagagagagaggagagccctgagaccgcagggctttggcctgggcagcttccactttctgccggacactctgaggagaggcagatggagctccaggcctcagcgttctcttttttccttgtctcccttctcccacccgggaaatgaaactgttgggctgggcgacggaggcagcagagactcggccattgcaggggcctctgggtgccttgtccgggcagtggtgaagtagccgcccctcccaccccggcacgatggggcctggcacctcgtctacccaacctcaccggaatgtaagcatctccgctgaacgactccctgcccttaccctacctctgagtttgtccatgtttatttcctgaagagagaagggactggcaagagggcttgggccccagcccaagggtggagagggggccaagggctcctgaccaaataggaaggacatttgagcagagcaaaatgaaaggaattacaaccaaaaaccccctccgagaagacaggcagcatggaaggcatggtggagatgactcaaacaaaaactatgattctagaccaaaaaggaa

SEQ ID NO: 301066 - DNA, 3197 bp, Homo sapiens
gatgggggtctgtaggaccgatggggagatggggggcactctgggcaggatgctggaaggcaaaggtctcccctggcccggcatgcccttagcccagcctctctctctccccgccagccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatatataaaagggaaagaagatgaggactcttcaagaataagatggaaccgcgaggcggagccaagcccctgcaccggtggtccaggcccttgttccccaaggcggatggaaggacggatgcttctttctcttcacaaatacctcatggacgttgtctttgggaaagccggagggggcggctggggcagggcctgtccctcggccagggcagatggaagcgggtgggcggggctgagagagggtatcagggacaggggtgaagagccccaaactcccctcccaaatcaactgaaaaagctttaaaaaaagacaggaaaaaaaggagtaagaaagcaaaaagaacagatgaaggaaaacttaacaacttttgggtggtttgattcctcctttgatttctttttcggttctcttttgtctgacctctctcctcccctccttcctctctcctcccctccttcctctctcctctcctccttcctgtctcctctctctccctttgctctcctctcttctctctcaatcttgttctttctgtgtctctcctcaaaccaaagtgttgcagtgaaggacacgagccattgaaatcagggtggggcctgacagccgtagtgtggcccctgccccttgttgggcaggagcagagagagaggagagccctgagaccgcagggctttggcctgggcagcttccactttctgccggacactctgaggagaggcagatggagctccaggcctcagcgttctcttttttccttgtctcccttctcccacccgggaaatgaaactgttgggctgggcgacggaggcagcagagactcggccattgcaggggcctctgggtgccttgtccgggcagtggtgaagtagccgcccctcccaccccggcacgatggggcctggcacctcgtctacccaacctcaccggaatgtaagcatctccgctgaacgactccctgcccttaccctacctctgagtttgtccatgtttatttcctgaagagagaagggactggcaagagggcttgggccccagcccaagggtggagagggggccaagggctcctgaccaaataggaaggacatttgagcagagcaaaatgaaaggaattacaaccaaaaaccccctccgagaagacaggcagcatggaaggcatggtggagatgactcaaacaaaaactatgattctagaccaaaaaggaa

SEQ ID NO: 301067 - DNA, 2922 bp, Homo sapiens
tggagacgcgtatcaggagagggtgggataatgacagccccaattttcagtaggggtaaagaggtagccacctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatatataaaagggaaagaagatgaggactcttcaagaataagatggaaccgcgaggcggagccaagcccctgcaccggtggtccaggcccttgttccccaaggcggatggaaggacggatgcttctttctcttcacaaatacctcatggacgttgtctttgggaaagccggagggggcggctggggcagggcctgtccctcggccagggcagatggaagcgggtgggcggggctgagagagggtatcagggacaggggtgaagagccccaaactcccctcccaaatcaactgaaaaagctttaaaaaaagacaggaaaaaaaggagtaagaaagcaaaaagaacagatgaaggaaaacttaacaacttttgggtggtttgattcctcctttgatttctttttcggttctcttttgtctgacctctctcctcccctccttcctctctcctcccctccttcctctctcctctcctccttcctgtctcctctctctccctttgctctcctctcttctctctcaatcttgttctttctgtgtctctcctcaaaccaaagtgttgcagtgaaggacacgagccattgaaatcagggtggggcctgacagccgtagtgtggcccctgccccttgttgggcaggagcagagagagaggagagccctgagaccgcagggctttggcctgggcagcttccactttctgccggacactctgaggagaggcagatggagctccaggcctcagcgttctcttttttccttgtctcccttctcccacccgggaaatgaaactgttgggctgggcgacggaggcagcagagactcggccattgcaggggcctctgggtgccttgtccgggcagtggtgaagtagccgcccctcccaccccggcacgatggggcctggcacctcgtctacccaacctcaccggaatgtaagcatctccgctgaacgactccctgcccttaccctacctctgagtttgtccatgtttatttcctgaagagagaagggactggcaagagggcttgggccccagcccaagggtggagagggggccaagggctcctgaccaaataggaaggacatttgagcagagcaaaatgaaaggaattacaaccaaaaaccccctccgagaagacaggcagcatggaaggcatggtggagatgactcaaacaaaaactatgattctagaccaaaaaggaa

SEQ ID NO: 301068 - DNA, 1364 bp, Homo sapiens
ctggggcccccagagagggtggggagatgacacagttgttcccccagccctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcatgtgggtgggggaatgggagagacagtgggaagagggtaggactcacccctcctctgcaggagcaactcagctttaatctgcttcacgatttcatatgagaaaagcatgggcctggtaaaaggtgaggcacttgagttttgtgcctggcctctgtcatttttaagctgtgtgaattcaagcacttattttatccttctaagcctcagtttttattaaattattatgaatgtgtaaaacataaaaagatataaatacatgtatgtaagagtg

SEQ ID NO: 301069 - DNA, 647 bp, Homo sapiens
  misc_feature (1)..(1): n is a, c, g, or t
nccaggctggtacaggccggagttttgggatcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacaggtgagactgtccattgagtgcaccaggccaggccagcagcaaggcctgctgaaagctgggtaaacgggggtgggggatgagtgagagtctcctttccatttgaccca

SEQ ID NO: 301070 - DNA, 3529 bp, Homo sapiens
cgtcaacatgagttgggcctggggcagatgaggctggctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagttactaccttatcctcagctgtggggacgctccaccccagccggacagctggagggggtgggggcgggggcggggctgcgccccccctcaattccatcccctctgtcactcccccacccccggccaccaccaacagcacaaaccccagccctcaaggcagccactcggctatcggcttgtcaggcctgaaccccagcacgggccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatatataaaagggaaagaagatgaggactcttcaagaataagatggaaccgcgaggcggagccaagcccctgcaccggtggtccaggcccttgttccccaaggcggatggaaggacggatgcttctttctcttcacaaatacctcatggacgttgtctttgggaaggtggaaatttcaggcaagaggggatgaagacattcagttgagggcattcagttgtctttttccatcctgtctgtttccctg

SEQ ID NO: 301071 - DNA, 4362 bp, Homo sapiens
ctggggcccccagagagggtggggagatgacacagttgttcccccagccctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagcacaaaccccagccctcaaggcagccactcggctatcggcttgtcaggcctgaaccccagcacgggccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatatataaaagggaaagaagatgaggactcttcaagaataagatggaaccgcgaggcggagccaagcccctgcaccggtggtccaggcccttgttccccaaggcggatggaaggacggatgcttctttctcttcacaaatacctcatggacgttgtctttgggaaagccggagggggcggctggggcagggcctgtccctcggccagggcagatggaagcgggtgggcggggctgagagagggtatcagggacaggggtgaagagccccaaactcccctcccaaatcaactgaaaaagctttaaaaaaagacaggaaaaaaaggagtaagaaagcaaaaagaacagatgaaggaaaacttaacaacttttgggtggtttgattcctcctttgatttctttttcggttctcttttgtctgacctctctcctcccctccttcctctctcctcccctccttcctctctcctctcctccttcctgtctcctctctctccctttgctctcctctcttctctctcaatcttgttctttctgtgtctctcctcaaaccaaagtgttgcagtgaaggacacgagccattgaaatcagggtggggcctgacagccgtagtgtggcccctgccccttgttgggcaggagcagagagagaggagagccctgagaccgcagggctttggcctgggcagcttccactttctgccggacactctgaggagaggcagatggagctccaggcctcagcgttctcttttttccttgtctcccttctcccacccgggaaatgaaactgttgggctgggcgacggaggcagcagagactcggccattgcaggggcctctgggtgccttgtccgggcagtggtgaagtagccgcccctcccaccccggcacgatggggcctggcacctcgtctacccaacctcaccggaatgtaagcatctccgctgaacgactccctgcccttaccctacctctgagtttgtccatgtttatttcctgaagagagaagggactggcaagagggcttgggccccagcccaagggtggagagggggccaagggctcctgaccaaataggaaggacatttgagcagagcaaaatgaaaggaattacaaccaaaaaccccctccgagaagacaggcagcatggaaggcatggtggagatgactcaaacaaaaactatgattctagaccaaaaaggaa

SEQ ID NO: 301072 - DNA, 4370 bp, Homo sapiens
ctggggcccccagagagggtggggagatgacacagttgttcccccagccctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacagaagcacaatggtggggttgagctccgggctgagtccagccctcatgagcaacaaccctttggccactatccaagccctggcctctggtggaaccctgccccttaccagccttgatggcagcgggaatctggtgctgggggcagccggtgcagccccggggagccctggcctggtgacctcgccgctcttcttgaatcatgctgggctgcccctgctcagcaccccgcctggtgtgggcctggtctcagcagcggctgcggctgtggcagcctccatctccagcaagtctcctggcctctcctcctcatcctcttcatcctcatcctcctcctcctccacttgcagcgagacggcagcacagacccctggaggtccaggggggcccgaggcagggtccaaacctgagtgagggccagccatgcctcccctcccattcctctggtccctgccttggtcccttgcctgggaagagggcgaggaggccagtggtggggacgcagagggtcctcagagcaggagtgacaagggaggaaagaccaaaaaaacaaccaaccaaaaaaaaaaaaaaaaaggaaagaaactaaccaacaaaagagaaaaccaaaaataatcacaacagaaaccagctgccccaaaggaaccagaggtgaaaaacaaacaaaaaaaaaccaaaaacaaaccaaaaaaaaaaaaaacccacaaaatcaaacaaaccaaaaaaccagtcgcgagccagacctcagcgtgctcaccctcactgctacgacgccaaataaaaaccccagccaggggcggagaagcctccagcaggtcagacctcatgccaccgagccctggctgtgggaccaacccccaaccctgcctcccccgtgggggctacagaaggaaaaagagaagatgccagcttcctaatcccagcccccagccctgggccagcgaagacagggcacagcctgggcagatgggctggggcttagcaccacccaccaaatgttcttttccagaaggtgaaagagaaagggcctgaacaaccttacaccaaatattcagtagcttcatccaaaggatgtacagaatttttagcattgtgctcaacagaatgtgtccctaccatgtgtccccttctcccctggcccccagctctccccacctgggcagggggtcttgctttaacctcctccctccccccagcaggggagagttcaagggaaggcctgcggacaacttttcatcccctgttcctccctcttttcccctttgaagggtgggctaggccattttgccaagttctagctctcacaagtccctcctcaaccctgtcaccctcctctgctctggaactgactccctccccagcctatgggaaggtggaaatttcaggcaagaggggatgaagacattcagttgagggcattcagttgtctttttccatcctgtctgtttccctgaaaaaaaaaaaaattcatattccagtgcctatccgtgggatccttcacgttctttgacattaaccagaaaccaaaaagagaactcacctcgcttttcccaccctgtgcccctctggtactggcgaatgcctctccctccccccacatgcacgcacgcacacaccccagtggtggggttcctcgagatggcatccccatcagggtccatgtggtggggacagtgccacagcctgtggtccccatctgagagggcgcggtggtggccaccactcccacaagacctccacaactcttggctggaccctgtgtttgaccagccccggacacgtctccactgacgacggacagaggagagacaccactgggagccaccctgccctcctgctattgtggaggccaacaaagttttgaaccgaaaaccaaaaaaacagaaacaaacaaacaataaatttaaactagaaaaaaaatttatatatatatataaacatatatatatatatatatatataaaagggaaagaagatgaggactcttcaagaataagatggaaccgcgaggcggagccaagcccctgcaccggtggtccaggcccttgttccccaaggcggatggaaggacggatgcttctttctcttcacaaatacctcatggacgttgtctttgggaaagccggagggggcggctggggcagggcctgtccctcggccagggcagatggaagcgggtgggcggggctgagagagggtatcagggacaggggtgaagagccccaaactcccctcccaaatcaactgaaaaagctttaaaaaaagacaggaaaaaaaggagtaagaaagcaaaaagaacagatgaaggaaaacttaacaacttttgggtggtttgattcctcctttgatttctttttcggttctcttttgtctgacctctctcctcccctccttcctctctcctcccctccttcctctctcctctcctccttcctgtctcctctctctccctttgctctcctctcttctctctcaatcttgttctttctgtgtctctcctcaaaccaaagtgttgcagtgaaggacacgagccattgaaatcagggtggggcctgacagccgtagtgtggcccctgccccttgttgggcaggagcagagagagaggagagccctgagaccgcagggctttggcctgggcagcttccactttctgccggacactctgaggagaggcagatggagctccaggcctcagcgttctcttttttccttgtctcccttctcccacccgggaaatgaaactgttgggctgggcgacggaggcagcagagactcggccattgcaggggcctctgggtgccttgtccgggcagtggtgaagtagccgcccctcccaccccggcacgatggggcctggcacctcgtctacccaacctcaccggaatgtaagcatctccgctgaacgactccctgcccttaccctacctctgagtttgtccatgtttatttcctgaagagagaagggactggcaagagggcttgggccccagcccaagggtggagagggggccaagggctcctgaccaaataggaaggacatttgagcagagcaaaatgaaaggaattacaaccaaaaaccccctccgagaagacaggcagcatggaaggcatggtggagatgactcaaacaaaaactatgattctagaccaaaaaggaa

SEQ ID NO: 301073 - DNA, 1600 bp, Homo sapiens
ctggggcccccagagagggtggggagatgacacagttgttcccccagccctggcggggcgggcagcatggttcactccagcatgggggctccagaaataagaatgtctaagcccctggaggccgagaagcaaggtctggactccccatcagagcacacagacaccgaaagaaatggaccagacactaatcatcagaacccccaaaataagacctccccattctccgtgtccccaactggccccagtacaaagatcaaggctgaagaccccagtggcgattcagccccagcagcacccctgccccctcagccggcccagcctcatctgccccaggcccaactcatgttgacgggcagccagctagctggggacatacagcagctcctccagctccagcagctggtgcttgtgccaggccaccacctccagccacctgctcagttcctgctaccgcaggcccagcagagccagccaggcctgctaccgacaccaaatctattccagctacctcagcaaacccagggagctcttctgacctcccagccccgggccgggcttcccacacagccccccaaatgcttggagccaccatcccaccccgaggagcccagtgatctggaggagctggagcaattcgcccgcaccttcaagcaacgccgcatcaagctgggcttcacgcagggtgatgtgggcctggccatgggcaagctctacggcaacgacttcagccagacgaccatttcccgcttcgaggccctcaacctgagcttcaagaacatgtgcaaactcaagcccctcctggagaagtggctcaacgatgcagagactatgtctgtggactcaagcctgcccagccccaaccagctgagcagccccagcctgggtttcgacggcctgcccggccggagacgcaagaagaggaccagcatcgagacaaacgtccgcttcgccttagagaagagttttctagcgaaccagaagcctacctcagaggagatcctgctgatcgccgagcagctgcacatggagaaggaagtgatccgcgtctggttctgcaaccggcgccagaaggagaaacgcatcaacccctgcagtgcggcccccatgctgcccagcccagggaagccggccagctacagcccccatatggtcacaccccaagggggcgcggggaccttaccgttgtcccaagcttccagcagtctgagcacaacaggtcagggagggcagaaaatggtgaggggggactgggaggatgtggcacagctggagcctgaggttcccaagtggctctgggtgtccatgggcctcaagactgggcctggggagtgtgggtgggggaatgggagagacagtgggaagagggtaggactcacccctcctctgcaggagcaactcagctttaatctgcttcacgatttcatatgagaaaagcatgggcctggtaaaaggtgaggcacttgagttttgtgcctggcctctgtcatttttaagctgtgtgaattcaagcacttattttatccttctaagcctcagtttttattaaattattatgaatgtgtaaaacataaaaagatataaatacatgtatgtaagagtg

SEQ ID NO: 301074 - DNA, 5194 bp, Homo sapiens
  misc_feature (2)..(3): n is a, c, g, or t
gnngaagatccaaggtgcgcgcgtcggcgtccgaggcggttggtgtcggagaatttgttaagcgggactccaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttgactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcagattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcagtccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttgattggttgcttggtttgttatttgaagggtgtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctatgctgctgcttcatgtgctacatctcagacttaaagagtttctctactacagtgaaaacattctctagggtctttcatcaggcctttagttattttagggataaaaactattgataaaaaggacaaggatagaacagagaaaatttaaagtcctgttccgggttttttgttatgttttctttaaaaactcagagactgatgttcaatatcccaaaccagtaaaatggtgaaaatactatgagcttgttttttaaaatatgattttttttggtactttataaa

SEQ ID NO: 301075 - DNA, 612 bp, Homo sapiens
aaaagccagctggtaatgtttattgcaactggggtgctatacaattagtaagatgatgcaatgagaatttctacttttgtatttcctgaccagcctgctcaaagtggcttttatatcaattgaatgattttcctcattttttaatacaggaaaccaattcgtgctcatggaagaaaagttcctttgccagcagccttgaagtgaatcttacaggagcaatgaaagtattgcattcattagcgtctgccccagagaaggttcagagaaaacttcacttgttttcaaggggatccttgtagatttacgtaattggaatcctgaagaacaggccctactgtctaaaaaatggcttttattcttctaaatacatataaacggatgttttatagatgggaagacatgaccttagaaaggagagagttttcagaggatttgccaggctgtcaggggctctgcctccaggcccagtgtggcagtgtggcctcagggcctccgcctccctgcttgagggctgcatggaggccaactgtcctgggagttgtaaaaatcttttaaggccagaccaatttgagggattttaaaaagtgtctcagtgcctcttatgatttcaga

SEQ ID NO: 301076 - DNA, 4797 bp, Homo sapiens
  misc_feature (2)..(3): n is a, c, g, or t
gnngaagatccaaggtgcgcgcgtcggcgtccgaggcggttggtgtcggagaatttgttaagcgggactccaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttgactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcaggtgggaacctgctcgtgctggtggatcagcacgctgcccatgagcgtatacgtctggagcagcttatcattgattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcagtccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttga

SEQ ID NO: 301077 - DNA, 5266 bp, Homo sapiens
  misc_feature (2)..(3): n is a, c, g, or t
gnngaagatccaaggtgcgcgcgtcggcgtccgaggcggttggtgtcggagaatttgttaagcgggactccaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttgactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcaggtgggaacctgctcgtgctggtggatcagcacgctgcccatgagcgtatacgtctggagcagcttatcattgattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcagtccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttgattggttgcttggtttgttatttgaagggtgtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctatgctgctgcttcatgtgctacatctcagacttaaagagtttctctactacagtgaaaacattctctagggtctttcatcaggcctttagttattttagggataaaaactattgataaaaaggacaaggatagaacagagaaaatttaaagtcctgttccgggttttttgttatgttttctttaaaaactcagagactgatgttcaatatcccaaaccagtaaaatggtgaaaatactatgagcttgttttttaaaatatgattttttttggtactttataaa

SEQ ID NO: 301078 - DNA, 5034 bp, Homo sapiens
  misc_feature (2)..(3): n is a, c, g, or t
gnngaagatccaaggtgcgcgcgtcggcgtccgaggcggttggtgtcggagaatttgttaagcgggactccaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttgactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcaggtgggaacctgctcgtgctggtggatcagcacgctgcccatgagcgtatacgtctggagcagcttatcattgattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcagtccatgcctccctgtgagccaccatgagaacagaatcactggtctaaaaggaacaaagggatgttcactgtatgcctctgagcagagagcagcagcagcagaaaccaattcgtgctcatggaagaaaagttcctttgccagcagccttgaagtgaatcttacaggagcaatgaaagtattgcattcattagcgtctgccccagagaaggttcagagaaaacttcacttgttttcaaggggatccttgtagatttacgtaattggaatcctgaagaacaggccctactgtctaaaaaatggcttttattcttctaaatacatataaacggatgttttatagatgggaagacatgaccttagaaaggagagagttttcagaggatttgccaggctgtcaggggctctgcctccaggcccagtgtggcagtgtggcctcagggcctccgcctccctgcttgagggctgcatggaggccaactgtcctgggagttgtaaaaatcttttaaggccagaccaatttgagggattttaaaaagtgtctcagtgcctcttatgatttcaga

SEQ ID NO: 301079 - DNA, 4967 bp, Homo sapiens
  misc_feature (2)..(3): n is a, c, g, or t
gnngaagatccaaggtgcgcgcgtcggcgtccgaggcggttggtgtcggagaatttgttaagcgggactccaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttgactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcaggtgggaacctgctcgtgctggtggatcagcacgctgcccatgagcgtatacgtctggagcagcttatcattgattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcagtccatgcctccctgtgagccaccatgagaacagaatcactggtctaaaaggaacaaagggatgttcactgtatgcctctgagcagagagcagcagcagcacaatgaaagtattgcattcattagcgtctgccccagagaaggttcagagaaaacttcacttgttttcaaggggatccttgtagatttacgtaattggaatcctgaagaacaggccctactgtctaaaaaatggcttttattcttctaaatacatataaacggatgttttatagatgggaagacatgaccttagaaaggagagagttttcagaggatttgccaggctgtcaggggctctgcctccaggcccagtgtggcagtgtggcctcagggcctccgcctccctgcttgagggctgcatggaggccaactgtcctgggagttgtaaaaatcttttaaggccagaccaatttgagggattttaaaaagtgtctcagtgcctcttatgatttcaga

SEQ ID NO: 301080 - DNA, 4643 bp, Homo sapiens
  misc_feature (2)..(3): n is a, c, g, or t
gnngaagatccaaggtgcgcgcgtcggcgtccgaggcggttggtgtcggagaatttgttaagcgggactccaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaactggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttgactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcaggtgggaacctgctcgtgctggtggatcagcacgctgcccatgagcgtatacgtctggagcagcttatcattgattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcagtccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttga

SEQ ID NO: 301081 - DNA, 1518 bp, Homo sapiens
agtaatgtcaaagagttaggcaaggacctaaggagtgcttcatggactagaatggcaatgatattactactgttttcacttttccttataaaatgacggcctaagagttgggaaagatatagtaaaaacagtgttagaaaaacttacctctacaggccctgcaccatttgagaatagtactaattctctccagagactgggagaccctgctcaaggaaagggaagccttctggagccataagactgtgtggtcaacccacatatgttcctggtaatccacattattcacctctgtcatcaaaacaacatttattaactacaggaacattggcttgttcatctgaatgtaagatgcaagtcttatatttcttattttgaaaaatactaccaaaattgttaataggctgaatatttattagtttgactttaaaaatggaaatccaaaatctaaaactgaacattaaacattctgctttgcattagaatgattatctcaaggccgtgctttatttttatctgaatctagaagacttcccttcctactcttaacccattcatctttctgccaatagattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcagtccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttga

SEQ ID NO: 301082 - DNA, 732 bp, Homo sapiens
aactctttcaggaactttggctacacacagaagaagagagatggggtgagagctaaaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcagtccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttga

SEQ ID NO: 301083 - DNA, 2944 bp, Homo sapiens
agcggaggctgagcggctacctgaatggggagggggcagacggcgctgagcgcggcggcggcgggagcggcgtcgagtgtctccgtgcgcccgtctgtggccaagcagccagcagcctagcagccagtcagcttgccgccggcggccaagcagccaaccatgctcaacttcggtgcctctctccagcagactgcggaggaaagaatggaaatgatttctgaaaggccaaaagagagtatgtattcctggaacaaaactgcagagaaaagtgattttgaagctgtagaagcacttatgtcaatgagctgcagttggaagtctgattttaagaaatacgttgaaaacagacctgttacaccagtatctgatttgtcagaggaagagaatctgcttccgggaacacctgattttcatacaatcccagcattttgtttgactccaccttacagtccttctgactttgaaccctctcaagtgtcaaatctgatggcaccagcgccatctactgtacacttcaagtcactctcagatactgccaaacctcacattgccgcacctttcaaagaggaagaaaagagcccagtatctgcccccaaactccccaaagctcaggcaacaagtgtgattcgtcatacagctgatgcccagctatgtaaccaccagacctgcccaatgaaagcagccagcatcctcaactatcagaacaattcttttagaagaagaacccacctaaatgttgaggctgcaagaaagaacataccatgtgccgctgtgtcaccaaacagatccaaatgtgagagaaacacagtggcagatgttgatgagaaagcaagtgctgcactttatgacttttctgtgccttcctcagagacggtcatctgcaggtctcagccagcccctgtgtccccacaacagaagtcagtgttggtctctccacctgcagtatctgcagggggagtgccacctatgccggtcatctgccagatggttccccttcctgccaacaaccctgttgtgacaacagtcgttcccagcactcctcccagccagccaccagccgtttgcccccctgttgtgttcatgggcacacaagtccccaaaggcgctgtcatgtttgtggtaccccagcccgttgtgcagagttcaaagcctccggtggtgagcccgaatggcaccagactctctcccattgcccctgctcctgggttttccccttcagcagcaaaagtcactcctcagattgattcatcaaggataaggagtcacatctgtagccacccaggatgtggcaagacatactttaaaagttcccatctgaaggcccacacgaggacgcacacaggagaaaagcctttcagctgtagctggaaaggttgtgaaaggaggtttgcccgttctgatgaactgtccagacacaggcgaacccacacgggtgagaagaaatttgcgtgccccatgtgtgaccggcggttcatgaggagtgaccatttgaccaagcatgcccggcgccatctatcagccaagaagctaccaaactggcagatggaagtgagcaagctaaatgacattgctctacctccaacccctgctcccacacagtgacagaccggaaagtgaagagtcagaactaactttggtctcagcgggagccagtggtgatgtaaaaatgcttccactgcaagtctgtggccccacaacgtgggcttaaagcagaagccccacagcctggcacgaaggccccgcctgggttaggtgactaaaagggcttcggccacaggcaggtcacagaaaggcaggtttcatttcttatcacataagagagatgagaaagcttttattcctttgaatattttttgaaggtttcagatgaggtcaacacaggtagcacagattttgaatctgtgtgcatatttgttactttacttttgctgtttatacttgagaccaacttttcaatgtgattcttctaaagcactggtttcaagaatatggaggctggaaggaaataaacattacggtacagacatggagatgtaaaatgagtttgtattattacaaatattgtcatctttttctagagttatcttctttattattcctagtctttccagtcaacatcgtggatgtagtgattaaatatatctagaactatcatttttacactattgtgaatatttggaattgaacgactgtatattgctaagagggcccaaagaattggaatcctccttaatttaattgctttgaagcatagctacaatttgtttttgcatttttgttttgaaagtttaacaaatgactgtatctaggcatttcattatgctttgaactttagtttgcctgcagtttcttgtgtagatttgaaaattgtataccaatgtgttttctgtagactctaagatacactgcactttgtttagaaaaaaaactgaagatgaaatatatattgtaaagaagggatattaagaatcttagataacttcttgaaaaagatggcttatgtcatcagtaaagtacctttatgttatgaggatataatgtgtgctttattgaattagaaaattagtgaccattattcacaggtggacaaatgttgtcctgttaatttataggcgttttttggggatgtggaggtagttgggtagaaaaattattagaacattcacttttgttaacagtatttctcttttattctgttatatagtggatgatatacacagtggcaaaacaaaagtacattgcttaaaatatatagtgaaaaatgtcactatatcttcccatttaacattgtttttgtatattgggtgtagatttctgacatcaaaacttggacccttggaaaacaaaagttttaattaaaaaaaatccttgtgacttacaatttgcacaatatttcttttgttgtactttatatcttgtttacaataaagaattccctttggta

SEQ ID NO: 301084 - DNA, 3289 bp, Homo sapiens
gtgcgagcggcgaggaatgttcccagtgactcacccgtgagcctcattgaggttagggcggccccatccgtcggtctccgccagctaggatctcccccgccgtccgcccccgcccctcgtctgcctcccccgcccgcgcctccgcccgcgcttccctttcctgcctcgcgccccactccctttcctcccctccctgtttcccttcctgtccttcccagctcacgctctctttccctgccgcctgcctttcttttttcctttttttgcattggcgtcttggggctgttacacacacgcgcgctgtccattgcagcttacataaaggcgggcgcgattatgcaattatattgttagcgatatttcaagagcaatggctcgttttcttaggatttcaacacgaaggcatcatgcatttttgaaaaactagtattgagaataataccttgcaacgtaaagaatgttttttggtatttttacacaatctctactttgaccaaacgagtctggacagttttcttttaatggaaaataggagaaatggaggaaagaatggaaatgatttctgaaaggccaaaagagagtatgtattcctggaacaaaactgcagagaaaagtgattttgaagctgtagaagcacttatgtcaatgagctgcagttggaagtctgattttaagaaatacgttgaaaacagacctgttacaccagtatctgatttgtcagaggaagagaatctgcttccgggaacacctgattttcatacaatcccagcattttgtttgactccaccttacagtccttctgactttgaaccctctcaagtgtcaaatctgatggcaccagcgccatctactgtacacttcaagtcactctcagatactgccaaacctcacattgccgcacctttcaaagaggaagaaaagagcccagtatctgcccccaaactccccaaagctcaggcaacaagtgtgattcgtcatacagctgatgcccagctatgtaaccaccagacctgcccaatgaaagcagccagcatcctcaactatcagaacaattcttttagaagaagaacccacctaaatgttgaggctgcaagaaagaacataccatgtgccgctgtgtcaccaaacagatccaaatgtgagagaaacacagtggcagatgttgatgagaaagcaagtgctgcactttatgacttttctgtgccttcctcagagacggtcatctgcaggtctcagccagcccctgtgtccccacaacagaagtcagtgttggtctctccacctgcagtatctgcagggggagtgccacctatgccggtcatctgccagatggttccccttcctgccaacaaccctgttgtgacaacagtcgttcccagcactcctcccagccagccaccagccgtttgcccccctgttgtgttcatgggcacacaagtccccaaaggcgctgtcatgtttgtggtaccccagcccgttgtgcagagttcaaagcctccggtggtgagcccgaatggcaccagactctctcccattgcccctgctcctgggttttccccttcagcagcaaaagtcactcctcagattgattcatcaaggataaggagtcacatctgtagccacccaggatgtggcaagacatactttaaaagttcccatctgaaggcccacacgaggacgcacacaggagaaaagcctttcagctgtagctggaaaggttgtgaaaggaggtttgcccgttctgatgaactgtccagacacaggcgaacccacacgggtgagaagaaatttgcgtgccccatgtgtgaccggcggttcatgaggagtgaccatttgaccaagcatgcccggcgccatctatcagccaagaagctaccaaactggcagatggaagtgagcaagctaaatgacattgctctacctccaacccctgctcccacacagtgacagaccggaaagtgaagagtcagaactaactttggtctcagcgggagccagtggtgatgtaaaaatgcttccactgcaagtctgtggccccacaacgtgggcttaaagcagaagccccacagcctggcacgaaggccccgcctgggttaggtgactaaaagggcttcggccacaggcaggtcacagaaaggcaggtttcatttcttatcacataagagagatgagaaagcttttattcctttgaatattttttgaaggtttcagatgaggtcaacacaggtagcacagattttgaatctgtgtgcatatttgttactttacttttgctgtttatacttgagaccaacttttcaatgtgattcttctaaagcactggtttcaagaatatggaggctggaaggaaataaacattacggtacagacatggagatgtaaaatgagtttgtattattacaaatattgtcatctttttctagagttatcttctttattattcctagtctttccagtcaacatcgtggatgtagtgattaaatatatctagaactatcatttttacactattgtgaatatttggaattgaacgactgtatattgctaagagggcccaaagaattggaatcctccttaatttaattgctttgaagcatagctacaatttgtttttgcatttttgttttgaaagtttaacaaatgactgtatctaggcatttcattatgctttgaactttagtttgcctgcagtttcttgtgtagatttgaaaattgtataccaatgtgttttctgtagactctaagatacactgcactttgtttagaaaaaaaactgaagatgaaatatatattgtaaagaagggatattaagaatcttagataacttcttgaaaaagatggcttatgtcatcagtaaagtacctttatgttatgaggatataatgtgtgctttattgaattagaaaattagtgaccattattcacaggtggacaaatgttgtcctgttaatttataggcgttttttggggatgtggaggtagttgggtagaaaaattattagaacattcacttttgttaacagtatttctcttttattctgttatatagtggatgatatacacagtggcaaaacaaaagtacattgcttaaaatatatagtgaaaaatgtcactatatcttcccatttaacattgtttttgtatattgggtgtagatttctgacatcaaaacttggacccttggaaaacaaaagttttaattaaaaaaaatccttgtgacttacaatttgcacaatatttcttttgttgtactttatatcttgtttacaataaagaattccctttggta

SEQ ID NO: 301085 - DNA, 2964 bp, Homo sapiens
  misc_feature (2947)..(2947): n is a, c, g, or t
agcggaggctgagcggctacctgaatggggagggggcagacggcgctgagcgcggcggcggcgggagcggcgtcgagtgtctccgtgcgcccgtctgtggccaagcagccagcagcctagcagccagtcagcttgccgccggcggccaagcagccaaccatgctcaacttcggtgcctctctccagcagactgcggaggaaagaatggaaatgatttctgaaaggccaaaagagagtatgtattcctggaacaaaactgcagagaaaagtgattttgaagctgtagaagcacttatgtcaatgagctgcagttggaagtctgattttaagaaatacgttgaaaacagacctgttacaccagtatctgatttgtcagaggaagagaatctgcttccgggaacacctgattttcatacaatcccagcattttgtttgactccaccttacagtccttctgactttgaaccctctcaagtgtcaaatctgatggcaccagcgccatctactgtacacttcaagtcactctcagatactgccaaacctcacattgccgcacctttcaaagaggaagaaaagagcccagtatctgcccccaaactccccaaagctcaggcaacaagtgtgattcgtcatacagctgatgcccagctatgtaaccaccagacctgcccaatgaaagcagccagcatcctcaactatcagaacaattcttttagaagaagaacccacctaaatgttgaggctgcaagaaagaacataccatgtgccgctgtgtcaccaaacagatccaaatgtgagagaaacacagtggcagatgttgatgagaaagcaagtgctgcactttatgacttttctgtgccttcctcagagacggtcatctgcaggtctcagccagcccctgtgtccccacaacagaagtcagtgttggtctctccacctgcagtatctgcagggggagtgccacctatgccggtcatctgccagatggttccccttcctgccaacaaccctgttgtgacaacagtcgttcccagcactcctcccagccagccaccagccgtttgcccccctgttgtgttcatgggcacacaagtccccaaaggcgctgtcatgtttgtggtaccccagcccgttgtgcagagttcaaagcctccggtggtgagcccgaatggcaccagactctctcccattgcccctgctcctgggttttccccttcagcagcaaaagtcactcctcagattgattcatcaaggataaggagtcacatctgtagccacccaggatgtggcaagacatactttaaaagttcccatctgaaggcccacacgaggacgcacacaggagaaaagcctttcagctgtagctggaaaggttgtgaaaggaggtttgcccgttctgatgaactgtccagacacaggcgaacccacacgggtgagaagaaatttgcgtgccccatgtgtgaccggcggttcatgaggagtgaccatttgaccaagcatgcccggcgccatctatcagccaagaagctaccaaactggcagatggaagtgagcaagctaaatgacattgctctacctccaacccctgctcccacacagtgacagaccggaaagtgaagagtcagaactaactttggtctcagcgggagccagtggtgatgtaaaaatgcttccactgcaagtctgtggccccacaacgtgggcttaaagcagaagccccacagcctggcacgaaggccccgcctgggttaggtgactaaaagggcttcggccacaggcaggtcacagaaaggcaggtttcatttcttatcacataagagagatgagaaagcttttattcctttgaatattttttgaaggtttcagatgaggtcaacacaggtagcacagattttgaatctgtgtgcatatttgttactttacttttgctgtttatacttgagaccaacttttcaatgtgattcttctaaagcactggtttcaagaatatggaggctggaaggaaataaacattacggtacagacatggagatgtaaaatgagtttgtattattacaaatattgtcatctttttctagagttatcttctttattattcctagtctttccagtcaacatcgtggatgtagtgattaaatatatctagaactatcatttttacactattgtgaatatttggaattgaacgactgtatattgctaagagggcccaaagaattggaatcctccttaatttaattgctttgaagcatagctacaatttgtttttgcatttttgttttgaaagtttaacaaatgactgtatctaggcatttcattatgctttgaactttagtttgcctgcagtttcttgtgtagatttgaaaattgtataccaatgtgttttctgtagactctaagatacactgcactttgtttagaaaaaaaactgaagatgaaatatatattgtaaagaagggatattaagaatcttagataacttcttgaaaaagatggcttatgtcatcagtaaagtacctttatgttatgaggatataatgtgtgctttattgaattagaaaattagtgaccattattcacaggtggacaaatgttgtcctgttaatttataggcgttttttggggatgtggaggtagttgggtagaaaaattattagaacattcacttttgttaacagtatttctcttttattctgttatatagtggatgatatacacagtggcaaaacaaaagtacattgcttaaaatatatagtgaaaaatgtcactatatcttcccatttaacattgtttttgtatattgggtgtagatttctgacatcaaaacttggacccttggaaaacaaaagttttaattaaaaaaaatccttgtgacttacaatttgcacaatatttcttttgttgtactttatatcttgtttacaataaagaattccctttggtaacnacaacaacaaacaacaa

SEQ ID NO: 301086 - DNA, 2890 bp, Homo sapiens
agcggaggctgagcggctacctgaatggggagggggcagacggcgctgagcgcggcggcggcgggagcggcgtcgagtgtctccgtgcgcccgtctgtggccaagcagccagcagcctagcagccagtcagcttgccgccggcggccaagcagccaaccatgctcaacttcggtgcctctctccagcagactgcggaggaaagaatggaaatgatttctgaaaggccaaaagagagtatgtattcctggaacaaaactgcagagaaaagtgattttgaagctgtagaagcacttatgtcaatgagctgcagttggaagtctgattttaagaaatacgttgaaaacagacctgttacaccagtatctgatttgtcagaggaagagaatctgcttccgggaacacctgattttcatacaatcccagcattttgtttgactccaccttacagtccttctgactttgaaccctctcaagtgtcaaatctgatggcaccagcgccatctactgtacacttcaagtcactctcagatactgccaaacctcacattgccgcacctttcaaagaggaagaaaagagcccagtatctgcccccaaactccccaaagctcaggcaacaagtgtgattcgtcatacagctgatgcccagctatgtaaccaccagacctgcccaatgaaagcagccagcatcctcaactatcagaacaattcttttagaagaagaacccacctaaatgttgaggctgcaagaaagaacataccatgtgccgctgtgtcaccaaacagatccaaatgtgagagaaacacagtggcagatgttgatgagaaagcaagtgctgcactttatgacttttctgtgccttcctcagagacggtcatctgcaggtctcagccagcccctgtgtccccacaacagaagtcagtgttggtctctccacctgcagtatctgcagggggagtgccacctatgccggtcatctgccagatggttccccttcctgccaacaaccctgttgtgacaacagtcgttcccagcactcctcccagccagccaccagccgtttgcccccctgttgtgttcatgggcacacaagtccccaaaggcgctgtcatgtttgtggtaccccagcccgttgtgcagagttcaaagcctccggtggtgagcccgaatggcaccagactctctcccattgcccctgctcctgggttttccccttcagcagcaaaagtcactcctcagattgattcatcaaggataaggagtcacatctgtagccacccaggatgtggcaagacatactttaaaagttcccatctgaaggcccacacgaggacgcacacaggagaaaagcctttcagctgtagctggaaaggttgtgaaaggaggtttgcccgttctgatgaactgtccagacacaggcgaacccacacgggtgagaagaaatttgcgtgccccatgtgtgaccggcggttcatgaggagtgaccatttgaccaagcatgcccggcgccatctatcagccaagaagctaccaaactggcagatggaagtgagcaagctaaatgacattgctctacctccaacccctgctcccacacagtgacagaccggaaagtgaagagtcagaactaactttggtctcagcgggagccagtggtgatgtaaaaatgcttccactgcaagtctgtggccccacaacgtgggcttaaagcagaagccccacagcctggcacgaaggccccgcctgggttaggtgacacataagagagatgagaaagcttttattcctttgaatattttttgaaggtttcagatgaggtcaacacaggtagcacagattttgaatctgtgtgcatatttgttactttacttttgctgtttatacttgagaccaacttttcaatgtgattcttctaaagcactggtttcaagaatatggaggctggaaggaaataaacattacggtacagacatggagatgtaaaatgagtttgtattattacaaatattgtcatctttttctagagttatcttctttattattcctagtctttccagtcaacatcgtggatgtagtgattaaatatatctagaactatcatttttacactattgtgaatatttggaattgaacgactgtatattgctaagagggcccaaagaattggaatcctccttaatttaattgctttgaagcatagctacaatttgtttttgcatttttgttttgaaagtttaacaaatgactgtatctaggcatttcattatgctttgaactttagtttgcctgcagtttcttgtgtagatttgaaaattgtataccaatgtgttttctgtagactctaagatacactgcactttgtttagaaaaaaaactgaagatgaaatatatattgtaaagaagggatattaagaatcttagataacttcttgaaaaagatggcttatgtcatcagtaaagtacctttatgttatgaggatataatgtgtgctttattgaattagaaaattagtgaccattattcacaggtggacaaatgttgtcctgttaatttataggcgttttttggggatgtggaggtagttgggtagaaaaattattagaacattcacttttgttaacagtatttctcttttattctgttatatagtggatgatatacacagtggcaaaacaaaagtacattgcttaaaatatatagtgaaaaatgtcactatatcttcccatttaacattgtttttgtatattgggtgtagatttctgacatcaaaacttggacccttggaaaacaaaagttttaattaaaaaaaatccttgtgacttacaatttgcacaatatttcttttgttgtactttatatcttgtttacaataaagaattccctttggta

SEQ ID NO: 301087 - DNA, 2533 bp, Homo sapiens
agcggaggctgagcggctacctgaatggggagggggcagacggcgctgagcgcggcggcggcgggagcggcgtcgagtgtctccgtgcgcccgtctgtggccaagcagccagcagcctagcagccagtcagcttgccgccggcggccaagcagccaaccatgctcaacttcggtgcctctctccagcagactgcggaggaaagaatggaaatgatttctgaaaggccaaaagagagtatgtattcctggaacaaaactgcagagaaaagtgattttgaagctgtagaagcacttatgtcaatgagctgcagttggaagtctgattttaagaaatacgttgaaaacagacctgttacaccagtatctgatttgtcagaggaagagaatctgcttccgggaacacctgattttcatacaatcccagcattttgtttgactccaccttacagtccttctgactttgaaccctctcaagtgtcaaatctgatggcaccagcgccatctactgtacacttcaagtcactctcagatactgccaaacctcacattgccgcacctttcaaagaggaagaaaagagcccagtatctgcccccaaactccccaaagctcaggcaacaagtgtgattcgtcatacagctgatgcccagctatgtaaccaccagacctgcccaatgaaagcagccagcatcctcaactatcagaacaattcttttagaagaagaacccacctaaatgttgaggctgcaagaaagaacataccatgtgccgctgtgtcaccaaacagatccaaatgtgagagaaacacagtggcagatgttgatgagaaagcaagtgctgcactttatgacttttctgtgccttcctcagagacggtcatctgcaggtctcagccagcccctgtgtccccacaacagaagtcagtgttggtctctccacctgcagtatctgcagggggagtgccacctatgccggtcatctgccagatggttccccttcctgccaacaaccctgttgtgacaacagtcgttcccagcactcctcccagccagccaccagccgtttgcccccctgttgtgttcatgggcacacaagtccccaaaggcgctgtcatgtttgtggtaccccagcccgttgtgcagagttcaaagcctccggtggtgagcccgaatggcaccagactctctcccattgcccctgctcctgggttttccccttcagcagcaaaagtcactcctcagattgattcatcaaggataaggagtcacatctgtagccacccaggatgtggcaagacatactttaaaagttcccatctgaaggcccacacgaggacgcacacaggagaaaagcctttcagctgtagctggaaaggttgtgaaaggaggtttgcccgttctgatgaactgtccagacacaggcgaacccacacgggtgagaagaaatttgcgtgccccatgtgtgaccggcggttcatgaggagtgaccatttgaccaagcatgcccggcgccatctatcagccaagaagctaccaaactggcagatggaagtgagcaagctaaatgacattgctctacctccaacccctgctcccacacagtgacagaccggaaagtgaagagtcagaactaactttggtctcagcgggagccagtggtgatgtaaaaatgcttccactgcaagtctgtggccccacaacgtgggcttaaagcagaagccccacagcctggcacgaaggccccgcctgggttaggtgactaaaagggcttcggccacaggcaggtcacagaaaggcaggtttcatttcttatcacataagagagatgagaaagcttttattcctttgaatattttttgaaggtttcagatgaggtcaacacaggtagcacagattttgaatctgtgtgcatatttgttactttacttttgctgtttatacttgagaccaacttttcaatgtgattcttctaaagcactggtttcaagaatatggaggctggaaggaaataaacattacggtacagacatggagatgtaaaatgagtttgtattattacaaatattgtcatctttttctagagttatcttctttattattcctagtctttccagtcaacatcgtggatgtagtgattaaatatatctagaactatcatttttacactattgtgaatatttggaattgaacgactgtatattgctaagagggcccaaagaattggaatcctccttaatttaattgctttgaagcatagctacaatttgtttttgcatttttgttttgaaagtttaacaaatgactgtatctaggcatttcattatgctttgaactttagtttgcctgcagtttcttgtgtagatttgaaaattgtataccaatgtgttttctgtagactctaagatacactgcactttgtttagaaaaaaaactgaagatgaaatatatattgtaaagaagggatattaagaatcttagataacttcttgaaaaagatggcttatgtcatcagtaaagtacctttatgttatgagga

SEQ ID NO: 301088 - DNA, 1941 bp, Homo sapiens
cacgcatcagaagtcacacacaaaaaaaggatgactacttacataaataaataaataaatgtgactcacattttagcggtttgtttcttcatcctagtcattgataccatcatagaagattcttactacaggcttatctttgatagtgatgtcagtgactgaggcagagatccttcccaggttccccagtcatattccaaagtctactgtgggctatggagcaaaacacagcactttgttatctccagctggttagggcacagcatgctctggattttattcctttcctttttattctctctcttttgccatgaatgcgtcctcgacggacgcattcaggagaaaagcctttcagctgtagctggaaaggttgtgaaaggaggtttgcccgttctgatgaactgtccagacacaggcgaacccacacgggtgagaagaaatttgcgtgccccatgtgtgaccggcggttcatgaggagtgaccatttgaccaagcatgcccggcgccatctatcagccaagaagctaccaaactggcagatggaagtgagcaagctaaatgacattgctctacctccaacccctgctcccacacagtgacagaccggaaagtgaagagtcagaactaactttggtctcagcgggagccagtggtgatgtaaaaatgcttccactgcaagtctgtggccccacaacgtgggcttaaagcagaagccccacagcctggcacgaaggccccgcctgggttaggtgactaaaagggcttcggccacaggcaggtcacagaaaggcaggtttcatttcttatcacataagagagatgagaaagcttttattcctttgaatattttttgaaggtttcagatgaggtcaacacaggtagcacagattttgaatctgtgtgcatatttgttactttacttttgctgtttatacttgagaccaacttttcaatgtgattcttctaaagcactggtttcaagaatatggaggctggaaggaaataaacattacggtacagacatggagatgtaaaatgagtttgtattattacaaatattgtcatctttttctagagttatcttctttattattcctagtctttccagtcaacatcgtggatgtagtgattaaatatatctagaactatcatttttacactattgtgaatatttggaattgaacgactgtatattgctaagagggcccaaagaattggaatcctccttaatttaattgctttgaagcatagctacaatttgtttttgcatttttgttttgaaagtttaacaaatgactgtatctaggcatttcattatgctttgaactttagtttgcctgcagtttcttgtgtagatttgaaaattgtataccaatgtgttttctgtagactctaagatacactgcactttgtttagaaaaaaaactgaagatgaaatatatattgtaaagaagggatattaagaatcttagataacttcttgaaaaagatggcttatgtcatcagtaaagtacctttatgttatgaggatataatgtgtgctttattgaattagaaaattagtgaccattattcacaggtggacaaatgttgtcctgttaatttataggcgttttttggggatgtggaggtagttgggtagaaaaattattagaacattcacttttgttaacagtatttctcttttattctgttatatagtggatgatatacacagtggcaaaacaaaagtacattgcttaaaatatatagtgaaaaatgtcactatatcttcccatttaacattgtttttgtatattgggtgtagatttctgacatcaaaacttggacccttggaaaacaaaagttttaattaaaaaaaatccttgtgacttacaatttgcacaatatttcttttgttgtactttatatcttgtttacaataaagaattccctttggta

SEQ ID NO: 301089 - DNA, 1675 bp, Homo sapiens
  misc_feature (1638)..(1638): n is a, c, g, or t
  misc_feature (1666)..(1666): n is a, c, g, or t
agcggaggctgagcggctacctgaatggggagggggcagacggcgctgagcgcggcggcggcgggagcggcgtcgagtgtctccgtgcgcccgtctgtggccaagcagccagcagcctagcagccagtcagcttgccgccggcggccaagcagccaaccatgctcaacttcggtgcctctctccagcagactgcggaggaaagaatggaaatgatttctgaaaggccaaaagagagtatgtattcctggaacaaaactgcagagaaaagtgattttgaagctgtagaagcacttatgtcaatgagctgcagttggaagtctgattttaagaaatacgttgaaaacagacctgttacaccagtatctgatttgtcagaggaagagaatctgcttccgggaacacctgattttcatacaatcccagcattttgtttgactccaccttacagtccttctgactttgaaccctctcaagtgtcaaatctgatggcaccagcgccatctactgtacacttcaagtcactctcagatactgccaaacctcacattgccgcacctttcaaagaggaagaaaagagcccagtatctgcccccaaactccccaaagctcaggcaacaagtgtgattcgtcatacagctgatgcccagctatgtaaccaccagacctgcccaatgaaagcagccagcatcctcaactatcagaacaattcttttagaagaagaacccacctaaatgttgaggctgcaagaaagaacataccatgtgccgctgtgtcaccaaacagatccaaatgtgagagaaacacagtggcagatgttgatgagaaagcaagtgctgcactttatgacttttctgtgccttcctcagagacggtcatctgcaggtctcagccagcccctgtgtccccacaacagaagtcagtgttggtctctccacctgcagtatctgcagggggagtgccacctatgccggtcatctgccagatggttccccttcctgccaacaaccctgttgtgacaacagtcgttcccagcactcctcccagccagccaccagccgtttgcccccctgttgtgttcatgggcacacaagtccccaaaggcgctgtcatgtttgtggtaccccagcccgttgtgcagagttcaaagcctccggtggtgagcccgaatggcaccagactctctcccattgcccctgctcctgggttttccccttcagcagcaaaagtcactcctcagattgattcatcaaggataaggagtcacatctgtagccacccaggatgtggcaagacatactttaaaagttcccatctgaaggcccacacgaggacgcacacaggagaaaagcctttcagctgtagctggaaaggttgtgaaaggaggtttgcccgttctgatgaactgtccagacacaggcgaacccacacgggtgagaagaaatttgcgtgccccatgtgtgaccggcggttcatgaggagtgaccatttgaccaagcatgcccggcgccatctatcagccaagaagctaccaaactggcagatggaagtgagcaagctaaatgacattgctctacctccaacccctgcccgccaaactacctttaaaaaaccctagcctccaaattttcagggaggntgatttgagtaataataaaacccctgtntcctgttaa

SEQ ID NO: 301090 - DNA, 389 bp, Homo sapiens
ctttccctgccgcctgcctttcttttttcctttttttgcattggcgtcttggggctgttacacacacgcgcgctgtccattgcagcttacataaaggcgggcgcgattatgcaattatattgttagcgatatttcaagagcaatggctcgttttcttaggatttcaacacgaaggcatcatgcatttttgaaaaactagtattgagaataataccttgcaacgtaaagaatgttttttggtatttttacacaatctctactttgaccaaacgagtctggacagttttcttttaatggaaaataggagaaatggtgagtagtaccatttttttttagcgtagttcaaagaactttactataaaacattaggtagttctacaaataagtgc

SEQ ID NO: 301091 - DNA, 374 bp, Homo sapiens
atgttgtcctgttaatttataggcgttttttggggatgtggaggtagttgggtagaaaaattattagaacattcacttttgttaacagtatttctcttttattctgttatatagtggatgatatacacagtggcaaaacaaaagtacattgcttaaaatatatagtgaaaaatgtcactatatcttcccatttaacattgtttttgtatattgggtgtagatttctgacatcaaaacttggacccttggaaaacaaaagttttaattaaaaaaaatccttgtgacttacaatttgcacaatatttcttttgttgtactttatatcttgtttacaataaagaattccctttggtatatggaatggtcattgcatt

SEQ ID NO: 301092 - DNA, 528 bp, Homo sapiens
cctaatttcttctctgagagtagggatagctaccaggcttctttttcttatgcttgtaagaatatacgacaggattctcctccctttatgctgaatattacctgttttgacatattccaaattttacttttctttccactgtttgaggcaataatttttaaaaaatgatgatgatgattcctgggcccacttaaatatagccgttagttatttttctgccatggcctgttccaagccttcgtgttgttataatccatcctcatctgtgcgtcttgtaaaaagtcatgattttcttcctggctcctttcaacatcatccccctctttctttagaaaataactttacctatttagagttacacacatagaagctacagcatctggaaagtgtcccttcaactccctgaaatttctttactgactacttacctgtgagattcatcttaactctactgaacatggaataattatataacaaaaacagtccaggtctgccaggctattccacaggcagtagctgcaaaagaat

SEQ ID NO: 301093 - DNA, 1832 bp, Homo sapiens
caatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggatttatagctaccttgggaaaactttcaggattacatggccaggaccttttggaattggagtaaagtctacgaccctttatattgtggagagtgttcacaatttcactttaccctcctgggccactgaggacaccatgactaagttgagagaatgtgcagaattgtccctcctgtccctctatggaattcacaagcagaaagagaaatctaggctccaagggggtgtcctggtcaatgaaatcctcaatcacatgaagagagcaactcagataccaagctacaaaaaacttatcatgtattctgcgcatgacactactgtgagtggcctacagatggcgctagatgtttacaacggactccttcctccctatgcttcttgccacttgacggaattgtactttgagaagggggagtactttgtggagatgtactaccggaatgagacgcagcacgagccgtatcccctcatgctacctggctgcagccccagctgtcctctggagaggtttgctgagctggttggccctgtgatccctcaagactggtccacggagtgtatgaccacaaacagccatcaagttctaaaggtcatctttgctgttgccttttgcctgatatctgctgtcctaatggtactactgtttatccacattcgccgtggactctgctggcagagagaatcctatgggaacatctgaacagacagctggataagccaggccaacctcctgtgacacagcatctctcagtggtgccgcatctaaaggacaggcttttgccatgtgggcattgccatcctcacaccctgccttttgaatctgcccagagcagggtctgaactcacagtgacccacagactgctgctggatgaacactcaggctacctaggtcttctcataatggagtggtagtgcaggctgcttgttcagctagaaagaggctgttatgcataggatggttgtattctctgccacagttgtccggagagaaataagaagccaaactccaatcagccttttacctgcaaagagtgaagggtgagaaggtggacaaagacatagattagaaaaatactggatattgggggaagttagactagaagtattattatacagggtgattcttacgaaagaagacccaatcataaattataaataaactttttatttagctattaagtaggttt

SEQ ID NO: 301094 - DNA, 502 bp, Homo sapiens
gcggtcgactactactactaaattcgcggccgcgtcgactgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttca

SEQ ID NO: 301095 - DNA, 561 bp, Homo sapiens
gcggtcgactactactactaaattcgcggccgcgtcgacgtaagggatcacatcctcaaccctgacaccaccaccacccctgctcatcatataaacagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttca

SEQ ID NO: 301096 - DNA, 439 bp, Homo sapiens
gcggtcgactactactactaaattcgcggccgcgtcgacggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttggtcgacgcggccgcgaatttagtagtagtaggcggccgc

SEQ ID NO: 301097 - DNA, 380 bp, Homo sapiens
gcggtcgactactactactaaattcgcggccgcgtcgacgtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttca

SEQ ID NO: 301098 - DNA, 572 bp, Homo sapiens
gcggtcgactactactactaaattcgcggccgcgtcgaccggaattgtactttgagaagggggagtactttgtggagatgtactaccggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttca

SEQ ID NO: 301099 - DNA, 1269 bp, Homo sapiens
caatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagtcccatcataggcatgaccatcgcatctctttatggctgaagcttagcctgactgctggacccagacttttgcccagtgacctctggggtaggttactatcctctttgtcctgccagtacccctagaaatttgacttaattgctgcatctagggacttagggatttttcccaaatgctgtgtagaaagtcactggagttaaatctactccaaccatttttctgctgtttcttgaaaagacaggatgattcatttacatctcttttccttcacagaatcatgagggaagtattgtgattaccagtgttaagcatttgtgaatattttattccaaaaagaaaaaaaatcactttaccagccttttctgcagagataaagactggaggtcaggtgcggtggctcatgcctgtaatcccagcactttggaaggctgaggcgggcagatcacctgaggtcaggagttcgagaccagcctggctaacatggtgaaaccccatttctactaaaaatacaaatattagctgggcatggtggtgcacgcctgtaatcccagctactcaggaggctgaggcaggagaatcacttaaacctgggaggtggaggttgcagtgagccaagatcgcaccgttgcactccagcttgggcaacaagagcgaaattccgtctcaaaaataaataaaaaacaaaacaaaacaaagactggatagcagcaccaaaatttagca

SEQ ID NO: 301100 - DNA, 401 bp, Homo sapiens
gcggtcgactactactactaaattcgcggccgcgtcgactgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctcc

SEQ ID NO: 301101 - DNA, 356 bp, Homo sapiens
gcggtcgactactactactaaattcgcggccgcgtcgacgtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttggtcgacgcggccgcgaatttagtagtagtaggcggccgc

SEQ ID NO: 301102 - DNA, 419 bp, Homo sapiens
gcggtcgactactactactaaattcgcggccgcgtcgacgtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcagtcgacgcggccgcgaatttagtagtagtaggcggccgc

SEQ ID NO: 301103 - DNA, 1169 bp, Homo sapiens
ctgggattaaaactaggcctatttcattccagagcaattttcttccctataaaatcatgattctcagacttagctgcatattaggatcacgtggttttttaaaaaaaatcctgatgcccagggcactctccgtaagaaatcggaatgtctgagggtggacccaggcatcagtgtttgaaaaataatctccctcgatgattccagtggggaggcaagtttgagaaccagtactataaactaagctgcctgaatggggctgtttgagagaaactctcaaacgtgtttacacaggttgggaccgaccaagctttctttaatcttttcagaggaatgggtatttttaaagtagcaatagataaatctaactaatcttccaggtgtgaaacttaaggctatatgaaagaaatagtttgggacaaagaatcccttcctaatttccctgcagtcccatcataggcatgaccatcgcatctctttatggctgaagcttagcctgactgctggacccagacttttgcccagtgacctctggggtaggttactatcctctttgtcctgccagtacccctagaaatttgacttaattgctgcatctagggacttagggatttttcccaaatgctgtgtagaaagtcactggagttaaatctactccaaccatttttctgctgtttcttgaaaagacaggatgattcatttacatctcttttccttcacagaatcatgagggaagtattgtgattaccagtgttaagcatttgtgaatattttattccaaaaagaaaaaaaatcactttaccagccttttctgcagagataaagactggaggtcaggtgcggtggctcatgcctgtaatcccagcactttggaaggctgaggcgggcagatcacctgaggtcaggagttcgagaccagcctggctaacatggtgaaaccccatttctactaaaaatacaaatattagctgggcatggtggtgcacgcctgtaatcccagctactcaggaggctgaggcaggagaatcacttaaacctgggaggtggaggttgcagtgagccaagatcgcaccgttgcactccagcttgggcaacaagagcgaaattccgtctcaaaaataaataaaaaacaaaacaaaacaaagactggatagcagcaccaaaatttagca

SEQ ID NO: 301104 - DNA, 692 bp, Homo sapiens
  misc_feature (376)..(377): n is a, c, g, or t
  misc_feature (395)..(395): n is a, c, g, or t
caatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaaaaaaaaaaaaaaacaaaaaaaaaacannttgttggggcgcggcctngggcccctggagaaagttttttaaacccattctcggttggggcgcgcgggggccccagttgggtaggggacctgtgggcccaagacggggttcccaaagggaacacccggggccaaaagacaaaggcggggggattctcttacccatttaaaaaaagcggccgggggggacccgggaggggttcttgtggacaaatctccagagagggcggccggggagggccaaacagggggcctatcacccggggagccccaggggagcccaaaataaaaccggccaccggtggggggggacgtc

SEQ ID NO: 301105 - DNA, 288 bp, Homo sapiens
gcggtcgactactactactaaattcgcggccgcgtcgactgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttggtcgacgcggccgcgaatttagtagtagtaggcggccgc

SEQ ID NO: 301106 - DNA, 448 bp, Homo sapiens
caatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtaagtagacttttctcattgctttttccttaaaactgtgttcccagcaaagtctgataaggcaagcgtcaggtttcatcttatccttggattgtttcccagagaccaggctctgttcaaactcagaaagtgaataatcaagttttgcaagttcctcttaatgaagacctaacgtgtcctaacaacttttaactttcaaaaacaactgcggtcgaagcataatacaattagtgaaggtt

SEQ ID NO: 301107 - DNA, 3212 bp, Homo sapiens
caatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggatttatagctaccttgggaaaactttcaggattacatggccaggaccttttggaattggagtaaagtctacgaccctttatattgtggagagtgttcacaatttcactttaccctcctgggccactgaggacaccatgactaagttgagagaatgtgcagaattgtccctcctgtccctctatggaattcacaagcagaaagagaaatctaggctccaagggggtgtcctggtcaatgaaatcctcaatcacatgaagagagcaactcagataccaagctacaaaaaacttatcatgtattctgcgcatgacactactgtgagtggcctacagatggcgctagatgtttacaacggactccttcctccctatgcttcttgccacttgacggaattgtactttgagaagggggagtactttgtggagatgtactaccggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaggacagtacagattagtgtgcacagagatctctgtagaaagagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaaccttgtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctcc

SEQ ID NO: 301108 - DNA, 3502 bp, Homo sapiens
  misc_feature (3186)..(3187): n is a, c, g, or t
  misc_feature (3205)..(3205): n is a, c, g, or t
caatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggatttatagctaccttgggaaaactttcaggattacatggccaggaccttttggaattggagtaaagtctacgaccctttatattgtggagagtgttcacaatttcactttaccctcctgggccactgaggacaccatgactaagttgagagaatgtgcagaattgtccctcctgtccctctatggaattcacaagcagaaagagaaatctaggctccaagggggtgtcctggtcaatgaaatcctcaatcacatgaagagagcaactcagataccaagctacaaaaaacttatcatgtattctgcgcatgacactactgtgagtggcctacagatggcgctagatgtttacaacggactccttcctccctatgcttcttgccacttgacggaattgtactttgagaagggggagtactttgtggagatgtactaccggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaggacagtacagattagtgtgcacagagatctctgtagaaagagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaaccttgtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtaaaaaaaaaaaaaacaaaaaaaaaacannttgttggggcgcggcctngggcccctggagaaagttttttaaacccattctcggttggggcgcgcgggggccccagttgggtaggggacctgtgggcccaagacggggttcccaaagggaacacccggggccaaaagacaaaggcggggggattctcttacccatttaaaaaaagcggccgggggggacccgggaggggttcttgtggacaaatctccagagagggcggccggggagggccaaacagggggcctatcacccggggagccccaggggagcccaaaataaaaccggccaccggtggggggggacgtc

SEQ ID NO: 301109 - DNA, 3123 bp, Homo sapiens
caatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggatttatagctaccttgggaaaactttcaggattacatggccaggaccttttggaattggagtaaagtctacgaccctttatattgtggagagtgttcacaatttcactttaccctcctgggccactgaggacaccatgactaagttgagagaatgtgcagaattgtccctcctgtccctctatggaattcacaagcagaaagagaaatctaggctccaagggggtgtcctggtcaatgaaatcctcaatcacatgaagagagcaactcagataccaagctacaaaaaacttatcatgtattctgcgcatgacactactgtgagtggcctacagatggcgctagatgtttacaacggactccttcctccctatgcttcttgccacttgacggaattgtactttgagaagggggagtactttgtggagatgtactaccggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaggacagtacagattagtgtgcacagagatctctgtagaaagagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaaccttgtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttca

SEQ ID NO: 301110 - DNA, 2997 bp, Homo sapiens
caatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggatttatagctaccttgggaaaactttcaggattacatggccaggaccttttggaattggagtaaagtctacgaccctttatattgtggagagtgttcacaatttcactttaccctcctgggccactgaggacaccatgactaagttgagagaatgtgcagaattgtccctcctgtccctctatggaattcacaagcagaaagagaaatctaggctccaagggggtgtcctggtcaatgaaatcctcaatcacatgaagagagcaactcagataccaagctacaaaaaacttatcatgtattctgcgcatgacactactgtgagtggcctacagatggcgctagatgtttacaacggactccttcctccctatgcttcttgccacttgacggaattgtactttgagaagggggagtactttgtggagatgtactaccggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaggacagtacagattagtgtgcacagagatctctgtagaaagagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaaccttgtctctacataaaatacaaaaacttagatgggcatggtggtgtgtgcctatagtcccactacttgtggggctaaggaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctcc

SEQ ID NO: 301111 - DNA, 3099 bp, Homo sapiens
caatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggatttatagctaccttgggaaaactttcaggattacatggccaggaccttttggaattggagtaaagtctacgaccctttatattgtggagagtgttcacaatttcactttaccctcctgggccactgaggacaccatgactaagttgagagaatgtgcagaattgtccctcctgtccctctatggaattcacaagcagaaagagaaatctaggctccaagggggtgtcctggtcaatgaaatcctcaatcacatgaagagagcaactcagataccaagctacaaaaaacttatcatgtattctgcgcatgacactactgtgagtggcctacagatggcgctagatgtttacaacggactccttcctccctatgcttcttgccacttgacggaattgtactttgagaagggggagtactttgtggagatgtactaccggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaggacagtacagattagtgtgcacagagatctctgtagaaagagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaaccttgtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttggtcgacgcggccgcgaatttagtagtagtaggcggccgc

SEQ ID NO: 301112 - DNA, 3466 bp, Homo sapiens
  misc_feature (3150)..(3151): n is a, c, g, or t
  misc_feature (3169)..(3169): n is a, c, g, or t
caatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggatttatagctaccttgggaaaactttcaggattacatggccaggaccttttggaattggagtaaagtctacgaccctttatattgtggagagtgttcacaatttcactttaccctcctgggccactgaggacaccatgactaagttgagagaatgtgcagaattgtccctcctgtccctctatggaattcacaagcagaaagagaaatctaggctccaagggggtgtcctggtcaatgaaatcctcaatcacatgaagagagcaactcagataccaagctacaaaaaacttatcatgtattctgcgcatgacactactgtgagtggcctacagatggcgctagatgtttacaacggactccttcctccctatgcttcttgccacttgacggaattgtactttgagaagggggagtactttgtggagatgtactaccggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaggacagtacagattagtgtgcacagagatctctgtagaaagagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaaccttgtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaaaaaaaaaaaacaaaaaaaaaacannttgttggggcgcggcctngggcccctggagaaagttttttaaacccattctcggttggggcgcgcgggggccccagttgggtaggggacctgtgggcccaagacggggttcccaaagggaacacccggggccaaaagacaaaggcggggggattctcttacccatttaaaaaaagcggccgggggggacccgggaggggttcttgtggacaaatctccagagagggcggccggggagggccaaacagggggcctatcacccggggagccccaggggagcccaaaataaaaccggccaccggtggggggggacgtc

SEQ ID NO: 301113 - DNA, 3189 bp, Homo sapiens
caatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggatttatagctaccttgggaaaactttcaggattacatggccaggaccttttggaattggagtaaagtctacgaccctttatattgtggagagtgttcacaatttcactttaccctcctgggccactgaggacaccatgactaagttgagagaatgtgcagaattgtccctcctgtccctctatggaattcacaagcagaaagagaaatctaggctccaagggggtgtcctggtcaatgaaatcctcaatcacatgaagagagcaactcagataccaagctacaaaaaacttatcatgtattctgcgcatgacactactgtgagtggcctacagatggcgctagatgtttacaacggactccttcctccctatgcttcttgccacttgacggaattgtactttgagaagggggagtactttgtggagatgtactaccggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaggacagtacagattagtgtgcacagagatctctgtagaaagagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaaccttgtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaaagaaataaaaaagtttttcccccaaatggaccgttttagtggagcgggcgcggaatttttatg

SEQ ID NO: 301114 - DNA, 3372 bp, Homo sapiens
caatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggatttatagctaccttgggaaaactttcaggattacatggccaggaccttttggaattggagtaaagtctacgaccctttatattgtggagagtgttcacaatttcactttaccctcctgggccactgaggacaccatgactaagttgagagaatgtgcagaattgtccctcctgtccctctatggaattcacaagcagaaagagaaatctaggctccaagggggtgtcctggtcaatgaaatcctcaatcacatgaagagagcaactcagataccaagctacaaaaaacttatcatgtattctgcgcatgacactactgtgagtggcctacagatggcgctagatgtttacaacggactccttcctccctatgcttcttgccacttgacggaattgtactttgagaagggggagtactttgtggagatgtactaccggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaggacagtacagattagtgtgcacagagatctctgtagaaagagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaaccttgtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaatagggaagaacacacgcgcagaacaacaaacaaggaaaaacacacaaaaccacacagaaaaaacaaagaagacaaaggcagcaacaagacaacgaccaatgacagaacaggccagaccgcgaacgagaagagaaaaaaaaaaagagcggcccgccaaaaaacaacaaacgacggacggcgaaacaaagagagaacccaaaagagcaagaggagaaaaaaaaacgaagcggagcacaagggagcgacaa

SEQ ID NO: 301115 - DNA, 3397 bp, Homo sapiens
  misc_feature (3397)..(3397): n is a, c, g, or t
caatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggatttatagctaccttgggaaaactttcaggattacatggccaggaccttttggaattggagtaaagtctacgaccctttatattgtggagagtgttcacaatttcactttaccctcctgggccactgaggacaccatgactaagttgagagaatgtgcagaattgtccctcctgtccctctatggaattcacaagcagaaagagaaatctaggctccaagggggtgtcctggtcaatgaaatcctcaatcacatgaagagagcaactcagataccaagctacaaaaaacttatcatgtattctgcgcatgacactactgtgagtggcctacagatggcgctagatgtttacaacggactccttcctccctatgcttcttgccacttgacggaattgtactttgagaagggggagtactttgtggagatgtactaccggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaggacagtacagattagtgtgcacagagatctctgtagaaagagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaaccttgtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaaaccacaacacaaacaaacacaaaaaaaaactggtgtgggcaccgcacagcgaccccgaaaaaaagttttttaaaacccatgttgtgtggggcccgcgggccgccgatgaggttcatgtgacaacatgtgcccaaaacggttcccagaaaaacaccggccctggactagggctgtgctttttcaccaataaaacgccgtggacaccgcgcttttgaacatcccatgtggccgaagcacaggggtctcacacggggcccggaccaataatcgn

SEQ ID NO: 301116 - DNA, 3262 bp, Homo sapiens
acctgtcatcaggcgcgaaccaagtagatcgccgcttcggccaggctgttagtaatcgccggtcgagctgaagtcggcaagggcagggtggtcgagcggttctcatgatcggtccacaccaccgaatcgcccgacaccgcaagccgatgggccagcccatgactccaaccaaaccccaacccacaatccacatccaccgcactggtgcgatacagccgcgtccacgcaaacggcaaaatcccgtccagtgcgccgtcggtgagtatcagcaattcctcgccggtgaccatcgacaccgggcagccgttgctaaccgactacctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggatttatagctaccttgggaaaactttcaggattacatggccaggaccttttggaattggagtaaagtctacgaccctttatattgtggagagtgttcacaatttcactttaccctcctgggccactgaggacaccatgactaagttgagagaatgtgcagaattgtccctcctgtccctctatggaattcacaagcagaaagagaaatctaggctccaagggggtgtcctggtcaatgaaatcctcaatcacatgaagagagcaactcagataccaagctacaaaaaacttatcatgtattctgcgcatgacactactgtgagtggcctacagatggcgctagatgtttacaacggactccttcctccctatgcttcttgccacttgacggaattgtactttgagaagggggagtactttgtggagatgtactaccggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaggacagtacagattagtgtgcacagagatctctgtagaaagagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaaccttgtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctcc

SEQ ID NO: 301117 - DNA, 3207 bp, Homo sapiens
ccgtatggtgcaacataaatgatccccatactcttaaaactattcctcatcacccgactaaaaatattaaacacaaactagcacctatcgtccctcgaccaaaatatacatggacctagaaccagaaaatgataacatagctctatagggacgtcgacagtcccgtgacataaggctgtttcgagccatggagatcgcggagaggtcccgagtcgacaccgtttcccacatgaccccgataaaggaagtcctcagtggacaccagggatctggccaactcaacccagtctgcgcatggagcagcattcctgaaggctttggacagtattttcgaaacgagatctagagggagttcttgaagtgagtcctagtggaacatgacacagggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggatttatagctaccttgggaaaactttcaggattacatggccaggaccttttggaattggagtaaagtctacgaccctttatattgtggagagtgttcacaatttcactttaccctcctgggccactgaggacaccatgactaagttgagagaatgtgcagaattgtccctcctgtccctctatggaattcacaagcagaaagagaaatctaggctccaagggggtgtcctggtcaatgaaatcctcaatcacatgaagagagcaactcagataccaagctacaaaaaacttatcatgtattctgcgcatgacactactgtgagtggcctacagatggcgctagatgtttacaacggactccttcctccctatgcttcttgccacttgacggaattgtactttgagaagggggagtactttgtggagatgtactaccggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaggacagtacagattagtgtgcacagagatctctgtagaaagagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaaccttgtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctcc

SEQ ID NO: 301118 - DNA, 2954 bp, Homo sapiens
caggaacatgtggcagtcagccagcatctatctacattttaaatgtaataataaggaataatcaattcgtgtttgtaaaattctttggaatgacattatcgtaaccaatattactggtgcatttttctgtgaagaacagcggttctcaacaggggcgcatttgcctcacaaggaacatttggcaatgtcgggagatattctgggttatacaagtgggagattaggaatgctactggcatctagtgggcagaggccaggatactgtgaaacatcctataatgcacaggagagctccctacaacaaacaattgtctggcccaaaatatcaataatgctgaagctgagaaacctgtgtaggaatttttctttctctgtttgtgtttcaggatttatagctaccttgggaaaactttcaggattacatggccaggaccttttggaattggagtaaagtctacgaccctttatattgtggagagtgttcacaatttcactttaccctcctgggccactgaggacaccatgactaagttgagagaatgtgcagaattgtccctcctgtccctctatggaattcacaagcagaaagagaaatctaggctccaagggggtgtcctggtcaatgaaatcctcaatcacatgaagagagcaactcagataccaagctacaaaaaacttatcatgtattctgcgcatgacactactgtgagtggcctacagatggcgctagatgtttacaacggactccttcctccctatgcttcttgccacttgacggaattgtactttgagaagggggagtactttgtggagatgtactaccggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaggacagtacagattagtgtgcacagagatctctgtagaaagagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaaccttgtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctcc

SEQ ID NO: 301119 - DNA, 2466 bp, Homo sapiens
caatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccagcattttgggagtccgaggtgggcagatcacttgacggaattgtactttgagaagggggagtactttgtggagatgtactaccggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaggacagtacagattagtgtgcacagagatctctgtagaaagagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaaccttgtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctcc

SEQ ID NO: 301120 - DNA, 1745 bp, Homo sapiens
gcggtcgactactactactaaattcgcggccgcgtcgacagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaaccttgtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaaaaacaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctcc

SEQ ID NO: 301121 - DNA, 2765 bp, Homo sapiens
caatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggatttatagctaccttgggaaaactttcaggattacatggccaggaccttttggaattggagtaaagtctacgaccctttatattgtggagagtgttcacaatttcactttaccctcctgggccactgaggacaccatgactaagttgagagaatgtgcagaattgtccctcctgtccctctatggaattcacaagcagaaagagaaatctaggctccaagggggtgtcctggtcaatgaaatcctcaatcacatgaagagagcaactcagataccaagctacaaaaaacttatcatgtattctgcgcatgacactactgtgagtggcctacagatggcgctagatgtttacaacggactccttcctccctatgcttcttgccacttgacggaattgtactttgagaagggggagtactttgtggagatgtactaccggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaggacagtacagattagtgtgcacagagatctctgtagaaagagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctagggtgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctccagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaaccttgtctctacataaaatacaaaaacttagatgggcatggtggtgtgtgcctatagtcccactacttgtggggctaaggaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccatctcatctttatccataatggtaatagagcacagtgttctctagacgtcga

SEQ ID NO: 301122 - DNA, 1028 bp, Homo sapiens
caatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagtcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctcc

SEQ ID NO: 301123 - DNA, 730 bp, Homo sapiens
gcggtcgactactactactaaattcgcggccgcgtcgacgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctcc

SEQ ID NO: 301124 - DNA, 691 bp, Homo sapiens
gcggtcgactactactactaaattcgcggccgcgtcgaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctcc

SEQ ID NO: 301125 - DNA, 591 bp, Homo sapiens
gcggtcgactactactactaaattcgcggccgcgtcgactgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctcc

SEQ ID NO: 301126 - DNA, 552 bp, Homo sapiens
gcggtcgactactactactaaattcgcggccgcgtcgacggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctcc

SEQ ID NO: 301127 - DNA, 516 bp, Homo sapiens
gcggtcgactactactactaaattcgcggccgcgtcgactaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctcc

SEQ ID NO: 301128 - DNA, 661 bp, Homo sapiens
gcggtcgactactactactaaattcgcggccgcgtcgaccggaattgtactttgagaagggggagtactttgtggagatgtactaccggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctcc

SEQ ID NO: 301129 - DNA, 469 bp, Homo sapiens
gcggtcgactactactactaaattcgcggccgcgtcgacgtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctcc

SEQ ID NO: 301130 - DNA, 438 bp, Homo sapiens
gcggtcgactactactactaaattcgcggccgcgtcgacaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctcc

SEQ ID NO: 301131 - DNA, 323 bp, Homo sapiens
gacaaagacatcgattgatatgcttctttgtgttatttccctcccaagtaaatgtttgtccttgggtccattttctatgcttgtaactgtcttctagcagtgagccaaatgtaaaatagtgaataaagtcattattaggaagttcaaaagcattgcttttataatgaacttagaaaaacgtatgtgtgtgtgtttaattagaataaaattcctctaggcagatttcaggagctcctccctttgtgtttggggtttttgttttagtataacaagatggaaaatattaatataaagtaaaatgatttgactggcttaaatgaaca

SEQ ID NO: 301132 - DNA, 831 bp, Homo sapiens
gacagggattcaccatattggtcaggctggtctctaacacttgctcagtgatccgcccgtctcggcctcccaaagtgctgggattacagatgtgagccatggcacctggtcagatgtctgctgtgatctttttcactggataggtcaagcacttttccacattgcctcatagtcttcattatgatcacctttaatgggctgggggaaagtctgtcaagtggctgtcccatacgttcacttaccccttaaatagtgtcatagtatatagcaagggtttcattgccagctgttttctcatccattcccatggtttccgctactacctatacaacagtgacacagatttatttttctagttctctccttcccaagctgcagatgcttcccagtgaggggctgcccccagctgagccagtccagtataatcagaccttcctgatggtccagccccttccttcctgagcgccatgcagcgtctcctcattcacccctgttcctcagctttggcagggtcgatatgattcacttaccacccaagctaacaactgaaatcatactcctgttcccccatcctccacgtgcatgtcagtctgtgtcctaaatgccacttggatccatccctgctcagcattctggctgctgctgttttaagtcccacaatttctcacctggaagatactgcaacagctacccaatgggtcaccttgcctccaggcctgcgcccccaactccacttgcggccaggatctgtacttagagtcaggccgacatgtgtctctactggacattttgtttttttttttttttagaaggagttttctaccctgtcac

SEQ ID NO: 301133 - DNA, 935 bp, Homo sapiens
tgctgcagggtgctgtatccatctacgtgcgctccagacttggtcgatacagttgacactgtcaatcctttaatcttgatcgacctgtctactcatcaagcctgagaccatcggtccaggaaagaggccagcccacgatcatagctcaagtgcacagttgagcgcatacacagtcactccttcaacacaagctatgtgagccatggcacctggtcagatgtctgctgtgatctttttcactggataggtcaagcacttttccacattgcctcatagtcttcattatgatcacctttaatgggctgggggaaagtctgtcaagtggctgtcccatacgttcacttaccccttaaatagtgtcatagtatatagcaagggtttcattgccagctgttttctcatccattcccatggtttccgctactacctatacaacagtgacacagatttatttttctagttctctccttcccaagctgcagatgcttcccagtgaggggctgcccccagctgagccagtccagtataatcagaccttcctgatggtccagccccttccttcctgagcgccatgcagcgtctcctcattcacccctgttcctcagctttggcagggtcgatatgattcacttaccacccaagctaacaactgaaatcatactcctgttcccccatcctccacgtgcatgtcagtctgtgtcctaaatgccacttggatccatccctgctcagcattctggctgctgctgttttaagtcccacaatttctcacctggaagatactgcaacagctacccaatgggtcaccttgcctccaggcctgcgcccccaactccacttgcggccaggatctgtacttagagtcaggccgacatgtgtctctactggacattttgtttttttttttttttagaaggagttttctaccctgtcac

SEQ ID NO: 301134 - DNA, 4436 bp, Homo sapiens
gcgagacaggaacttctttccccttctctgtgtcaggatcgcagaaagtatgtcccttctctcaccatgagctggctctccagttcccagggagtggtactaacagcctaccaccccagcggcaaggaccaggccgtcgggaacagccatgcaaaggcaggggaggaagccacctcgagtcgcagatatggccagtacactatgaaccaggaaagcaccaccatcaaagttatggagaagcctccatttgatcgatcaatttcccaggattctttggatgaactatctatggaagactattggatagaactagaaaacatcaagaaatctagtgaaaacagccaagaagatcaagaggtggttgttgtcaaagagcctgatgagggagaattggaagaagagtggcttaaagaggccggtttatccaatctcttcggagagtctgctggagatccacaggaaagcattgtgtttttatcaacattgacgcggacccaggcagcagcagttcagaagcgagtagagacggtctcccagaccttgaggaaaaaaaacaaacagtaccagattcctgacgtcagagacatatttgctcaacagagagaatcaaaagaaacagctccaggtggcactgaatcgcagtcacttagaacaaatgaaaacaaataccaaggaagagatgacgaggcatctaaccttgttggtgaagagaagctgatcccacctgaggagacgcctgcccctgaaacagacatcaacctggaggtatcatttgccgagcaagcactcaatcagaaagagagctccaaggagaaaatccagaagagcaaaggcgatgatgccacattacctagtttcagattgccaaaagacaaaacgggtaccacaaggattggtgacctcgcaccccaggacatgaagaaagtttgccatttagccctaattgagctgactgccctctatgatgtattgggtattgagctgaaacaacaaaaagctgtgaaaatcaaaacaaaagattctggtcttttttgcgttccattgacagcgctattagaacaagatcagaggaaagtaccaggaatgcgaatacccttgatctttcaaaaactgatttctcgaattgaagagagaggtttggaaacagaaggcctcttacggatccctggagctgccattagaatcaagaatctttgccaagaactagaagcaaagttttatgaagggacttttaattgggaaagtgtcaaacagcatgatgccgccagcctgctgaagctcttcattcgggagttgccccagccactgctcagtgtggagtatctcaaagcctttcaggctgtccagaatcttccaaccaagaagcagcaactacaggctttgaaccttcttgtcatcctcctacctgatgcaaacagggacacactgaaggcccttcttgaatttctccaaagagtaatagataataaagaaaaaaataaaatgacagtcatgaatgtagcaatggtcatggccccgaatctctttatgtgtcatgcattgggattgaagtccagtgaacagcgagaatttgtaatggcagctgggacagcaaataccatgcacttattgattaagtaccaaaaacttctgtggacaattcccaagtttattgtaaaccaagtgaggaagcaaaacacggaaaatcataaaaaggataaaagagccatgaagaaattgctgaagaaaatggcttatgaccgagaaaaatatgaaaagcaagataagagtacaaatgatgctgacgttcctcagggagtgattcgagtgcaagctccccatctttcgaaagtttccatggcaatacagctaactgaagaactaaaagccagtgatgtacttgccaggtttctcagccaagaaagtggggttgcccagactctcaagaaaggagaagtttttttgtatgaaattggaggaaatattggggaacgctgccttgatgatgacacttacatgaaggatttatatcagcttaacccaaatgctgagtgggttataaagtcaaagccattgtagaagacttaacaagctgcagataaccatgtggacttctgtcataattcttgctgagtcaagagtgtaaataaaagaaatggcaggactcatattattcagttgtacccaagtatttaaaaatgactctcttaagccttaaaaagtcatagatttgtgctgctgccagaattatattaattattattaatgttattattagaaaaaaaatttctggagtgagagtaaagaggcttaattagtttgtgggcagttttcatatgctctgtgaaatgtgtccagatgtgacatagtttttttttttaatatgtggaaatgtcttctcttcccattcttttctcctaaaatcatatatactgtaatatatgctctctcacctctattacctcctcacatctaccctttcccagttaggtttgctttttgaccaaaaagataacaaataccaggtatggcaagttgtgaagacagcacattaaaacatacctaatttcacagtattcctgtcacgacagaatgttagtattcatctctttgaatcatttgctcaaataataacattccaccttttcctgctgtatcacaggaagtgatttgcattttttttcagttcatctgacttatgttcacagaaccgtatcagcgaccaagaaaataggactgtcagaagctgccagttattactgaaccattaaatacttatatactaagaataaataaaatatacccatgtgaaataataattggattatggataacaagagagtgaaagccaaagcactttctgtctactgtactcttctaaatggaattttaaaagtcatagctggctttacgtgttgtcattattagcattataaatatgcatgatagtataatccagtaatggttgaagaatgtattttacttaaagagggatttttttttttaagtcctgaataagtctactggaagaattattcttctgggtgaaaaagcttttgtttgtgttcttattttaaataatcggagtcaatttattaaaatgttcttgaaagtactattcccagggattttaatgcacaaaccatattgtgacaagagatgagcctctgtactgtaaataagaaatgaagtagagaaatgttaaatattttatgagtttagaatatagtaaataaaaggtgatgtaaatgaatgctgcacaaacggtgttcatgatacttttagtagtactttaggaaaaactacacattctcagaagctcttgatgtctctaatgaagggggggaatgctgttaatgagaacagtcataaatttttagcatataattacaagaacagcctgtggatatgatcacttaaatgattttgtggtgattcgtgccattgcttttttatttaaaagaaaattttgtaattaaatgcctttttctaaattatcttctcttggaatcattacttttaatcctatgtgtttatgagtatttttgctttttttttattaatattgagaaatggacttttttgttattaaaagtcacctctattttctattttctttgtaatttttaaagtaggaagatgtcagagatgtaaatatgttttcgtctttagtttttttccttttacaaatttttattcttcaggattttcaaaatacagtttagtctgtttctttgacaatatgtattaatttcccaattagcaaaatggtacttattagtgggttgaaaacaattaataatataaaagaaaaattaagtgcttaaaacattttaggagtatacaacttcaaaaaaaaagatagcagtgaggataatgatttaagtaaaaggttgtctgaagcatatgccaactaaatttcgcaacgtttgctacctacctgaaaaggagggtcaggagggagacacaacatatttttgatcatgaaaaagtatcttaattttaaaaaagtgaaaatgccattttattttgaatcccttttagaactcacgacccaagttcatcaatgttgaataatatcacgtttaaataacaaaaaaatatggactttaaaaaatctcaaattttttagagacagggtcttgctctgttttccagattggagtacagcagtgcattcgcggctaactgcagcctcaagcactggggctcaagcaaacctcctgcctcagcctcgtgagtagctaggaccacaggtgcatgccaccatgcctggctctaaagagaaaaaaaacttgataccatagagccttgaatataaatatcctgatgttaacctactgcttttgctgtgattttttttccttagtgagttttaaatctcaggctagatttttatttgtttttctgtgtgtgtatgagacaaaataaaaataaatatatttgcaaaaaaaaaa

SEQ ID NO: 301135 - DNA, 3471 bp, Homo sapiens
gcgagacaggaacttctttccccttctctgtgtcaggatcgcagaaagtatgtcccttctctcaccatgagctggctctccagttcccagggagtggtactaacagcctaccaccccagcggcaaggaccaggccgtcgggaacagccatgcaaaggcaggggaggaagccacctcgagtcgcagatatggccagtacactatgaaccaggaaagcaccaccatcaaagttatggagaagcctccatttgatcgatcaatttcccaggattctttggatgaactatctatggaagactattggatagaactagaaaacatcaagaaatctagtgaaaacagccaagaagatcaagaggtggttgttgtcaaagagcctgatgagggagaattggaagaagagtggcttaaagaggccggtttatccaatctcttcggagagtctgctggagatccacaggaaagcattgtgtttttatcaacattgacgcggacccaggcagcagcagttcagaagcgagtagagacggtctcccagaccttgaggaaaaaaaacaaacagtaccagattcctgacgtcagagacatatttgctcaacagagagaatcaaaagaaacagctccaggtggcactgaatcgcagtcacttagaacaaatgaaaacaaataccaaggaagagatgacgaggcatctaaccttgttggtgaagagaagctgatcccacctgaggagacgcctgcccctgaaacagacatcaacctggaggtatcatttgccgagcaagcactcaatcagaaagagagctccaaggagaaaatccagaagagcaaaggcgatgatgccacattacctagtttcagattgccaaaagacaaaacgggtaccacaaggattggtgacctcgcaccccaggacatgaagaaagtttgccatttagccctaattgagctgactgccctctatgatgtattgggtattgagctgaaacaacaaaaagctgtgaaaatcaaaacaaaagattctggtcttttttgcgttccattgacagcgctattagaacaagatcagaggaaagtaccaggaatgcgaatacccttgatctttcaaaaactgatttctcgaattgaagagagaggtttggaaacagaaggcctcttacggatccctggagctgccattagaatcaagaatctttgccaagaactagaagcaaagttttatgaagggacttttaattgggaaagtgtcaaacagcatgatgccgccagcctgctgaagctcttcattcgggagttgccccagccactgctcagtgtggagtatctcaaagcctttcaggctgtccagaatcttccaaccaagaagcagcaactacaggctttgaaccttcttgtcatcctcctacctgatgcaaacagggacacactgaaggcccttcttgaatttctccaaagagtaatagataataaagaaaaaaataaaatgacagtcatgaatgtagcaatggtcatggccccgaatctctttatgtgtcatgcattgggattgaagtccagtgaacagcgagaatttgtaatggcagctgggacagcaaataccatgcacttattgattaagtaccaaaaacttctgtggacaattcccaagtttattgtaaaccaagtgaggaagcaaaacacggaaaatcataaaaaggataaaagagccatgaagaaattgctgaagaaaatggcttatgaccgagaaaaatatgaaaagcaagataagagtacaaatgatgctgacgttcctcagggagtgattcgagtgcaagctccccatctttcgaaagtttccatggcaatacagctaactgaagaactaaaagccagtgatgtacttgccaggtttctcagccaagaaagtggggttgcccagactctcaagaaaggagaagtttttttgtatgaaattggaggaaatattggggaacgctgccttgatgatgacacttacatgaaggatttatatcagcttaacccaaatgctgagtgggttataaagtcaaagccattgtagaagacttaacaagctgcagataaccatgtggacttctgtcataattcttgctgagtcaagagtgtaaataaaagaaatggcaggactcatattattcagttgtacccaagtatttaaaaatgactctcttaagccttaaaaagtcatagatttgtgctgctgccagaattatattaattattattaatgttattattagaaaaaaaatttctggagtgagagtaaagaggcttaattagtttgtgggcagttttcatatgctctgtgaaatgtgtccagatgtgacatagtttttttttttaatatgtggaaatgtcttctcttcccattcttttctcctaaaatcatatatactgtaatatatgctctctcacctctattacctcctcacatctaccctttcccagttaggtttgctttttgaccaaaaagataacaaataccaggtatggcaagttgtgaagacagcacattaaaacatacctaatttcacagtattcctgtcacgacagaatgttagtattcatctctttgaatcatttgctcaaataataacattccaccttttcctgctgtatcacaggaagtgatttgcattttttttcagttcatctgacttatgttcacagaaccgtatcagcgaccaagaaaataggactgtcagaagctgccagttattactgaaccattaaatacttatatactaagaataaataaaatatacccatgtgaaataataattggattatggataacaagagagtgaaagccaaagcactttctgtctactgtactcttctaaatggaattttaaaagtcatagctggctttacgtgttgtcattattagcattataaatatgcatgatagtataatccagtaatggttgaagaatgtattttacttaaagagggatttttttttttaagtcctgaataagtctactggaagaattattcttctgggtgaaaaagcttttgtttgtgttcttattttaaataatcggagtcaatttattaaaatgttcttgaaagtactattcccagggattttaatgcacaaaccatattgtgacaagagatgagcctctgtactgtaaataagaaatgaagtagagaaatgttaaatattttatgagtttagaatatagtaaataaaaggtgatgtaaatgaatgctgcacaaacggtgttcatgatacttttagtagtactttaggaaaaactacacattctcagaagctcttgatgtctctaatgaagggggggaatgctgttaatgagaacagtcataaatttttagcatataattacaagaacagcctgtggatatgatcacttaaatgattttgtggtgattcgtgccattgcttttttatttaaaagaaaattttgtaattaaatgcctttttcta

SEQ ID NO: 301136 - DNA, 2744 bp, Homo sapiens
gaggcctgctttccatcagggtagcaattccctggatttgagtaggagccgttccttttgcatggaacatggaccatctactttgctgctgacgttcctcagggagtgattcgagtgcaagctccccatctttcgaaagtttccatggcaatacagctaactgaagaactaaaagccagtgatgtacttgccaggtttctcagccaagaaagtggggttgcccagactctcaagaaaggagaagtttttttgtatgaaattggaggaaatattggggaacgctgccttgatgatgacacttacatgaaggatttatatcagcttaacccaaatgctgagtgggttataaagtcaaagccattgtagaagacttaacaagctgcagataaccatgtggacttctgtcataattcttgctgagtcaagagtgtaaataaaagaaatggcaggactcatattattcagttgtacccaagtatttaaaaatgactctcttaagccttaaaaagtcatagatttgtgctgctgccagaattatattaattattattaatgttattattagaaaaaaaatttctggagtgagagtaaagaggcttaattagtttgtgggcagttttcatatgctctgtgaaatgtgtccagatgtgacatagtttttttttttaatatgtggaaatgtcttctcttcccattcttttctcctaaaatcatatatactgtaatatatgctctctcacctctattacctcctcacatctaccctttcccagttaggtttgctttttgaccaaaaagataacaaataccaggtatggcaagttgtgaagacagcacattaaaacatacctaatttcacagtattcctgtcacgacagaatgttagtattcatctctttgaatcatttgctcaaataataacattccaccttttcctgctgtatcacaggaagtgatttgcattttttttcagttcatctgacttatgttcacagaaccgtatcagcgaccaagaaaataggactgtcagaagctgccagttattactgaaccattaaatacttatatactaagaataaataaaatatacccatgtgaaataataattggattatggataacaagagagtgaaagccaaagcactttctgtctactgtactcttctaaatggaattttaaaagtcatagctggctttacgtgttgtcattattagcattataaatatgcatgatagtataatccagtaatggttgaagaatgtattttacttaaagagggatttttttttttaagtcctgaataagtctactggaagaattattcttctgggtgaaaaagcttttgtttgtgttcttattttaaataatcggagtcaatttattaaaatgttcttgaaagtactattcccagggattttaatgcacaaaccatattgtgacaagagatgagcctctgtactgtaaataagaaatgaagtagagaaatgttaaatattttatgagtttagaatatagtaaataaaaggtgatgtaaatgaatgctgcacaaacggtgttcatgatacttttagtagtactttaggaaaaactacacattctcagaagctcttgatgtctctaatgaagggggggaatgctgttaatgagaacagtcataaatttttagcatataattacaagaacagcctgtggatatgatcacttaaatgattttgtggtgattcgtgccattgcttttttatttaaaagaaaattttgtaattaaatgcctttttctaaattatcttctcttggaatcattacttttaatcctatgtgtttatgagtatttttgctttttttttattaatattgagaaatggacttttttgttattaaaagtcacctctattttctattttctttgtaatttttaaagtaggaagatgtcagagatgtaaatatgttttcgtctttagtttttttccttttacaaatttttattcttcaggattttcaaaatacagtttagtctgtttctttgacaatatgtattaatttcccaattagcaaaatggtacttattagtgggttgaaaacaattaataatataaaagaaaaattaagtgcttaaaacattttaggagtatacaacttcaaaaaaaaagatagcagtgaggataatgatttaagtaaaaggttgtctgaagcatatgccaactaaatttcgcaacgtttgctacctacctgaaaaggagggtcaggagggagacacaacatatttttgatcatgaaaaagtatcttaattttaaaaaagtgaaaatgccattttattttgaatcccttttagaactcacgacccaagttcatcaatgttgaataatatcacgtttaaataacaaaaaaatatggactttaaaaaatctcaaattttttagagacagggtcttgctctgttttccagattggagtacagcagtgcattcgcggctaactgcagcctcaagcactggggctcaagcaaacctcctgcctcagcctcgtgagtagctaggaccacaggtgcatgccaccatgcctggctctaaagagaaaaaaaacttgataccatagagccttgaatataaatatcctgatgttaacctactgcttttgctgtgattttttttccttagtgagttttaaatctcaggctagatttttatttgtttttctgtgtgtgtatgagacaaaataaaaataaatatatttgcaaaaaaaaaa

SEQ ID NO: 301137 - DNA, 2748 bp, Homo sapiens
acacacacacacacacacacccctacacccctacccctacctctacctctcgtgcggagactctagtcgcctactgaatatataatctatagctgacgttcctcagggagtgattcgagtgcaagctccccatctttcgaaagtttccatggcaatacagctaactgaagaactaaaagccagtgatgtacttgccaggtttctcagccaagaaagtggggttgcccagactctcaagaaaggagaagtttttttgtatgaaattggaggaaatattggggaacgctgccttgatgatgacacttacatgaaggatttatatcagcttaacccaaatgctgagtgggttataaagtcaaagccattgtagaagacttaacaagctgcagataaccatgtggacttctgtcataattcttgctgagtcaagagtgtaaataaaagaaatggcaggactcatattattcagttgtacccaagtatttaaaaatgactctcttaagccttaaaaagtcatagatttgtgctgctgccagaattatattaattattattaatgttattattagaaaaaaaatttctggagtgagagtaaagaggcttaattagtttgtgggcagttttcatatgctctgtgaaatgtgtccagatgtgacatagtttttttttttaatatgtggaaatgtcttctcttcccattcttttctcctaaaatcatatatactgtaatatatgctctctcacctctattacctcctcacatctaccctttcccagttaggtttgctttttgaccaaaaagataacaaataccaggtatggcaagttgtgaagacagcacattaaaacatacctaatttcacagtattcctgtcacgacagaatgttagtattcatctctttgaatcatttgctcaaataataacattccaccttttcctgctgtatcacaggaagtgatttgcattttttttcagttcatctgacttatgttcacagaaccgtatcagcgaccaagaaaataggactgtcagaagctgccagttattactgaaccattaaatacttatatactaagaataaataaaatatacccatgtgaaataataattggattatggataacaagagagtgaaagccaaagcactttctgtctactgtactcttctaaatggaattttaaaagtcatagctggctttacgtgttgtcattattagcattataaatatgcatgatagtataatccagtaatggttgaagaatgtattttacttaaagagggatttttttttttaagtcctgaataagtctactggaagaattattcttctgggtgaaaaagcttttgtttgtgttcttattttaaataatcggagtcaatttattaaaatgttcttgaaagtactattcccagggattttaatgcacaaaccatattgtgacaagagatgagcctctgtactgtaaataagaaatgaagtagagaaatgttaaatattttatgagtttagaatatagtaaataaaaggtgatgtaaatgaatgctgcacaaacggtgttcatgatacttttagtagtactttaggaaaaactacacattctcagaagctcttgatgtctctaatgaagggggggaatgctgttaatgagaacagtcataaatttttagcatataattacaagaacagcctgtggatatgatcacttaaatgattttgtggtgattcgtgccattgcttttttatttaaaagaaaattttgtaattaaatgcctttttctaaattatcttctcttggaatcattacttttaatcctatgtgtttatgagtatttttgctttttttttattaatattgagaaatggacttttttgttattaaaagtcacctctattttctattttctttgtaatttttaaagtaggaagatgtcagagatgtaaatatgttttcgtctttagtttttttccttttacaaatttttattcttcaggattttcaaaatacagtttagtctgtttctttgacaatatgtattaatttcccaattagcaaaatggtacttattagtgggttgaaaacaattaataatataaaagaaaaattaagtgcttaaaacattttaggagtatacaacttcaaaaaaaaagatagcagtgaggataatgatttaagtaaaaggttgtctgaagcatatgccaactaaatttcgcaacgtttgctacctacctgaaaaggagggtcaggagggagacacaacatatttttgatcatgaaaaagtatcttaattttaaaaaagtgaaaatgccattttattttgaatcccttttagaactcacgacccaagttcatcaatgttgaataatatcacgtttaaataacaaaaaaatatggactttaaaaaatctcaaattttttagagacagggtcttgctctgttttccagattggagtacagcagtgcattcgcggctaactgcagcctcaagcactggggctcaagcaaacctcctgcctcagcctcgtgagtagctaggaccacaggtgcatgccaccatgcctggctctaaagagaaaaaaaacttgataccatagagccttgaatataaatatcctgatgttaacctactgcttttgctgtgattttttttccttagtgagttttaaatctcaggctagatttttatttgtttttctgtgtgtgtatgagacaaaataaaaataaatatatttgcaaaaaaaaaa

SEQ ID NO: 301138 - DNA, 3244 bp, Homo sapiens
gcgagacaggaacttctttccccttctctgtgtcaggatcgcagaaagtatgtcccttctctcaccatgagctggctctccagttcccagggagtggtactaacagcctaccaccccagcggcaaggaccaggccgtcgggaacagccatgcaaaggcaggggaggaagccacctcgagtcgcagatatggccagtacactatgaaccaggaaagcaccaccatcaaagttatggagaagcctccatttgatcgatcaatttcccaggattctttggatgaactatctatggaagactattggatagaactagaaaacatcaagaaatctagtgaaaacagccaagaagatcaagaggtggttgttgtcaaagagcctgatgagggagaattggaagaagagtggcttaaagaggccggtttatccaatctcttcggagagtctgctggagatccacaggaaagcattgtgtttttatcaacattgacgcggacccaggcagcagcagttcagaagcgagtagagacggtctcccagaccttgaggaaaaaaaacaaacagtaccagattcctgacgtcagagacatatttgctcaacagagagaatcaaaagaaacagctccaggtggcactgaatcgcagtcacttagaacaaatgaaaacaaataccaaggaagagatgacgaggcatctaaccttgttggtgaagagaagctgatcccacctgaggagacgcctgcccctgaaacagacatcaacctggaggtatcatttgccgagcaagcactcaatcagaaagagagctccaaggagaaaatccagaagagcaaaggcgatgatgccacattacctagtttcagattgccaaaagacaaaacgggtaccacaaggattggtgacctcgcaccccaggacatgaagaaagtttgccatttagccctaattgagctgactgccctctatgatgtattgggtattgagctgaaacaacaaaaagctgtgaaaatcaaaacaaaagattctggtcttttttgcgttccattgacagcgctattagaacaagatcagaggaaagtaccaggaatgcgaatacccttgatctttcaaaaactgatttctcgaattgaagagagaggtttggaaacagaaggcctcttacggatccctggagctgccattagaatcaagaatctttgccaagaactagaagcaaagttttatgaagggacttttaattgggaaagtgtcaaacagcatgatgccgccagcctgctgaagctcttcattcgggagttgccccagccactgctcagtgtggagtatctcaaagcctttcaggctgtccagaatcttccaaccaagaagcagcaactacaggctttgaaccttcttgtcatcctcctacctgatgcaaacagggacacactgaaggcccttcttgaatttctccaaagagtaatagataataaagaaaaaaataaaatgacagtcatgaatgtagcaatggtcatggccccgaatctctttatgtgtcatgcattgggattgaagtccagtgaacagcgagaatttgtaatggcagctgggacagcaaataccatgcacttattgattaagtaccaaaaacttctgtggacaattcccaagtttattgtaaaccaagtgaggaagcaaaacacggaaaatcataaaaaggataaaagagccatgaagaaattgctgaagaaaatggcttatgaccgagaaaaatatgaaaagcaagataagagtacaaatgatgctgacgttcctcagggagtgattcgagtgcaagctccccatctttcgaaagtttccatggcaatacagctaactgaagaactaaaagccagtgatgtacttgccaggtttctcagccaagaaagtggggttgcccagactctcaagaaaggagaagtttttttgtatgaaattggaggaaatattggggaacgctgccttgatgatgacacttacatgaaggatttatatcagcttaacccaaatgctgagtgggttataaagtcaaagccattgtagaagacttaacaagctgcagataaccatgtggacttctgtcataattcttgctgagtcaagagtgtaaataaaagaaatggcaggactcatattattcagttgtacccaagtatttaaaaatgactctcttaagccttaaaaagtcatagatttgtgctgctgccagaattatattaattattattaatgttattattagaaaaaaaatttctggagtgagagtaaagaggcttaattagtttgtgggcagttttcatatgctctgtgaaatgtgtccagatgtgacatagtttttttttttaatatgtggaaatgtcttctcttcccattcttttctcctaaaatcatatatactgtaatatatgctctctcacctctattacctcctcacatctaccctttcccagttaggtttgctttttgaccaaaaagataacaaataccaggtatggcaagttgtgaagacagcacattaaaacatacctaatttcacagtattcctgtcacgacagaatgttagtattcatctctttgaatcatttgctcaaataataacattccaccttttcctgctgtatcacaggaagtgatttgcattttttttcagttcatctgacttatgttcacagaaccgtatcagcgaccaagaaaataggactgtcagaagctgccagttattactgaaccattaaatacttatatactaagaataaataaaatatacccatgtgaaataataattggattatggataacaagagagtgaaagccaaagcactttctgtctactgtactcttctaaatggaattttaaaagtcatagctggctttacgtgttgtcattattagcattataaatatgcatgatagtataatccagtaatggttgaagaatgtattttacttaaagagggatttttttttttaagtcctgaataagtctactggaagaattattcttctgggtgaaaaagcttttgtttgtgttcttattttaaataatcggagtcaatttattaaaatgttcttgaaagtactattcccagggattttaatgcacaaaccatattgtgacaagagatgagcctctgtactgtaaataagaaatgaagtagagaaatgttaaatattttatgagtttagaatatagtaaataaaaggtgatgtaaatgaatgctgcacaaac

SEQ ID NO: 301139 - DNA, 2072 bp, Homo sapiens
gcgagacaggaacttctttccccttctctgtgtcaggatcgcagaaagtatgtcccttctctcaccatgagctggctctccagttcccagggagtggtactaacagcctaccaccccagcggcaaggaccaggccgtcgggaacagccatgcaaaggcaggggaggaagccacctcgagtcgcagatatggccagtacactatgaaccaggaaagcaccaccatcaaagttatggagaagcctccatttgatcgatcaatttcccaggattctttggatgaactatctatggaagactattggatagaactagaaaacatcaagaaatctagtgaaaacagccaagaagatcaagaggtggttgttgtcaaagagcctgatgagggagaattggaagaagagtggcttaaagaggccggtttatccaatctcttcggagagtctgctggagatccacaggaaagcattgtgtttttatcaacattgacgcggacccaggcagcagcagttcagaagcgagtagagacggtctcccagaccttgaggaaaaaaaacaaacagtaccagattcctgacgtcagagacatatttgctcaacagagagaatcaaaagaaacagctccaggtggcactgaatcgcagtcacttagaacaaatgaaaacaaataccaaggaagagatgacgaggcatctaaccttgttggtgaagagaagctgatcccacctgaggagacgcctgcccctgaaacagacatcaacctggaggtatcatttgccgagcaagcactcaatcagaaagagagctccaaggagaaaatccagaagagcaaaggcgatgatgccacattacctagtttcagattgccaaaagacaaaacgggtaccacaaggattggtgacctcgcaccccaggacatgaagaaagtttgccatttagccctaattgagctgactgccctctatgatgtattgggtattgagctgaaacaacaaaaagctgtgaaaatcaaaacaaaagattctggtcttttttgcgttccattgacagcgctattagaacaagatcagaggaaagtaccaggaatgcgaatacccttgatctttcaaaaactgatttctcgaattgaagagagaggtttggaaacagaaggcctcttacggatccctggagctgccattagaatcaagaatctttgccaagaactagaagcaaagttttatgaagggacttttaattgggaaagtgtcaaacagcatgatgccgccagcctgctgaagctcttcattcgggagttgccccagccactgctcagtgtggagtatctcaaagcctttcaggctgtccagaatcttccaaccaagaagcagcaactacaggctttgaaccttcttgtcatcctcctacctgatgcaaacagggacacactgaaggcccttcttgaatttctccaaagagtaatagataataaagaaaaaaataaaatgacagtcatgaatgtagcaatggtcatggccccgaatctctttatgtgtcatgcattgggattgaagtccagtgaacagcgagaatttgtaatggcagctgggacagcaaataccatgcacttattgattaagtaccaaaaacttctgtggacaattcccaagtttattgtaaaccaagtgaggaagcaaaacacggaaaatcataaaaaggataaaagagccatgaagaaattgctgaagaaaatggcttatgaccgagaaaaatatgaaaagcaagataagagtacaaatgatgctgacgttcctcagggagtgattcgagtgcaagctccccatctttcgaaagtttccatggcaatacagctaactgaagaactaaaagccagtgatgtacttgccaggtttctcagccaagaaaggggggtggcccagactctcaagaaaggggaagttttttgtgtgaaattggcgggaattatggggggacgctgcctgatgatgaaccttcatgaagggtttttatcagttacccaatgtgggtgggtttaagcaacctgtgaaaattagcgggaaacagggggttggaa

SEQ ID NO: 301140 - DNA, 313 bp, Homo sapiens
atcagggtagcaattccctggatttgagtaggagccgttccttttgcatggaacatggaccatctactttgctgtaagccatgccccctccttcattctgtctggttgctgtagtttcttgactctcctccaaatcatttaaatatgcaatatgaaactatagggcatgaaattgcctgggggtagcttttgtcatttgttaaacagttacttgatatgtgcctactgtgtgccaggaattactgggtacttgaaatataaattattggacaaaacatacaaagatcactgctcttccagagcttaaattcta

SEQ ID NO: 301141 - DNA, 342 bp, Homo sapiens
ctcataaaatccagtttacatgtcattgtaatcagttttatttatatgtgaaacagatgttaaattcggaattgtacctgttacaaatacggaaattagaatgtttctctgtttatgcacagctgatttctcgaattgaagagagaggtttggaaacagaaggcctcttacggatccctggagctgccattagaatcaaggtaatctctgggttctactaatgtaaacattttattgtttatttacacttatgcattttaaaagctaacttgtcctctctaccccttttttccattgttagtaaagtagataaaataaaacaataaaaccttttaccattca

SEQ ID NO: 301142 - DNA, 2543 bp, Homo sapiens
gtgcggagtcaggcgcagcggctccctataagcagaggagctgtccgtgtgctgaaacggcccgagaagctcgcccggagaacggggaggaatatgctgtggagctcctctgccatataaacaaaaagaggaaatctttcaaacatggctgaagcaaagacccactggcttggagcagccctgtctcttatccctttaattttcctcatctctggggctgaagcagcttcatttcagagaaaccagctgcttcagaaagaaccagacctcaggttggaaaatgtccaaaagtttcccagtcctgaaatgatcagggctttggagtacatagaaaacctccgacaacaagctcataaggaagaaagcagcccagattataatccctaccaaggtgtctctgtcccccttcagcaaaaagaaaatggcgatgaaagccacttgcccgagagggattcactgagtgaagaagactggatgagaataatactcgaagctttgagacaggctgaaaatgagcctcagtctgcaccaaaagaaaataagccctatgccttgaattcagaaaagaactttccaatggacatgagtgatgattatgagacacagcagtggccagaaagaaagcttaagcacatgcaattccctcctatgtatgaagagaattccagggataacccctttaaacgcacaaatgaaatagtggaggaacaatatactcctcaaagccttgctacattggaatctgtcttccaagagctggggaaactgacaggaccaaacaaccagaaacgtgagaggatggatgaggagcaaaaactttatacggatgatgaagatgatatctacaaggctaataacattgcctatgaagatgtggtcgggggagaagactggaacccagtagaggagaaaatagagagtcaaacccaggaagaggtgagagacagcaaagagaatatagaaaaaaatgaacaaatcaacgatgagatgaaacgctcagggcagcttggcatccaggaagaagatcttcggaaagagagtaaagaccaactctcagatgatgtctccaaagtaattgcctatttgaaaaggttagtaaatgctgcaggaagtgggaggttacagaatgggcaaaatggggaaagggccaccaggctttttgagaaacctcttgattctcagtctatttatcagctgattgaaatctcaaggaatttacagatacccccagaagacttaattgagatgctcaaaactggggagaagccgaatggatcagtggaaccggagcgggagcttgaccttcctgttgacctagatgacatctcagaggctgacttagaccatccagacctgttccaaaataggatgctctccaagagtggctaccctaaaacacctggtcgtgctgggactgaggccctaccagacgggctcagtgttgaggatattttaaatcttttagggatggagagtgcagcaaatcagaaaacgtcgtattttcccaatccatataaccaggagaaagttctgccaaggctcccttatggtgctggaagatctagatcgaaccagcttcccaaagctgcctggattccacatgttgaaaacagacagatggcatatgaaaacctgaacgacaaggatcaagaattaggtgagtacttggccaggatgctagttaaataccctgagatcattaattcaaaccaagtgaagcgagttcctggtcaaggctcatctgaagatgacctgcaggaagaggaacaaattgagcaggccatcaaagagcatttgaatcaaggcagctctcaggagactgacaagctggccccggtgagcaaaaggttccctgtggggcccccgaagaatgatgataccccaaataggcagtactgggatgaagatctgttaatgaaagtgctggaatacctcaaccaagaaaaggcagaaaagggaagggagcatattgctaagagagcaatggaaaatatgtaagctgctttcattaattaccctactttcattcctcccaccccaagcaaatcccaacatttctcttcagtgtgttgacttctatcctgttaacactgtaatatctttaaatgatgtacaggcagatgaaaccaggtcactggggagtctgcttcatttcctctgagctgttatcttgtgtatggatatgtgtaaatgttatgactccttgataaaaaatttattatgtccattattcaagaaagatatctatgactgtgtttaatagtatatctaatggctgtggcattgttgatgctcacatatgataaaaaagtgtcctataattctattgaaagtttttaatatttattgaattattttgttactgtctgtagtgttttgtggagtactggaccaaaaaaataaagcattataaatatatagttttatttataaggccttttctattgtgtgttttactgttgattaataaatgttatttctggacaaaaaaaaaaaatatgcctggagcgcatacatccatgggcgcggttccgcgggtgggg

SEQ ID NO: 301143 - DNA, 2480 bp, Homo sapiens
cgcgttcttctctatcttcaacactatgtggcggccgcgttttcctcccccccttgcccttttgcgcgaaatctttcaaacatggctgaagcaaagacccactggcttggagcagccctgtctcttatccctttaattttcctcatctctggggctgaagcagcttcatttcagagaaaccagctgcttcagaaagaaccagacctcaggttggaaaatgtccaaaagtttcccagtcctgaaatgatcagggctttggagtacatagaaaacctccgacaacaagctcataaggaagaaagcagcccagattataatccctaccaaggtgtctctgtcccccttcagcaaaaagaaaatggcgatgaaagccacttgcccgagagggattcactgagtgaagaagactggatgagaataatactcgaagctttgagacaggctgaaaatgagcctcagtctgcaccaaaagaaaataagccctatgccttgaattcagaaaagaactttccaatggacatgagtgatgattatgagacacagcagtggccagaaagaaagcttaagcacatgcaattccctcctatgtatgaagagaattccagggataacccctttaaacgcacaaatgaaatagtggaggaacaatatactcctcaaagccttgctacattggaatctgtcttccaagagctggggaaactgacaggaccaaacaaccagaaacgtgagaggatggatgaggagcaaaaactttatacggatgatgaagatgatatctacaaggctaataacattgcctatgaagatgtggtcgggggagaagactggaacccagtagaggagaaaatagagagtcaaacccaggaagaggtgagagacagcaaagagaatatagaaaaaaatgaacaaatcaacgatgagatgaaacgctcagggcagcttggcatccaggaagaagatcttcggaaagagagtaaagaccaactctcagatgatgtctccaaagtaattgcctatttgaaaaggttagtaaatgctgcaggaagtgggaggttacagaatgggcaaaatggggaaagggccaccaggctttttgagaaacctcttgattctcagtctatttatcagctgattgaaatctcaaggaatttacagatacccccagaagacttaattgagatgctcaaaactggggagaagccgaatggatcagtggaaccggagcgggagcttgaccttcctgttgacctagatgacatctcagaggctgacttagaccatccagacctgttccaaaataggatgctctccaagagtggctaccctaaaacacctggtcgtgctgggactgaggccctaccagacgggctcagtgttgaggatattttaaatcttttagggatggagagtgcagcaaatcagaaaacgtcgtattttcccaatccatataaccaggagaaagttctgccaaggctcccttatggtgctggaagatctagatcgaaccagcttcccaaagctgcctggattccacatgttgaaaacagacagatggcatatgaaaacctgaacgacaaggatcaagaattaggtgagtacttggccaggatgctagttaaataccctgagatcattaattcaaaccaagtgaagcgagttcctggtcaaggctcatctgaagatgacctgcaggaagaggaacaaattgagcaggccatcaaagagcatttgaatcaaggcagctctcaggagactgacaagctggccccggtgagcaaaaggttccctgtggggcccccgaagaatgatgataccccaaataggcagtactgggatgaagatctgttaatgaaagtgctggaatacctcaaccaagaaaaggcagaaaagggaagggagcatattgctaagagagcaatggaaaatatgtaagctgctttcattaattaccctactttcattcctcccaccccaagcaaatcccaacatttctcttcagtgtgttgacttctatcctgttaacactgtaatatctttaaatgatgtacaggcagatgaaaccaggtcactggggagtctgcttcatttcctctgagctgttatcttgtgtatggatatgtgtaaatgttatgactccttgataaaaaatttattatgtccattattcaagaaagatatctatgactgtgtttaatagtatatctaatggctgtggcattgttgatgctcacatatgataaaaaagtgtcctataattctattgaaagtttttaatatttattgaattattttgttactgtctgtagtgttttgtggagtactggaccaaaaaaataaagcattataaatatatagttttatttataaggccttttctattgtgtgttttactgttgattaataaatgttatttctggacaaaaaaaaaaaatatgcctggagcgcatacatccatgggcgcggttccgcgggtgggg

SEQ ID NO: 301144 - DNA, 2458 bp, Homo sapiens
  misc_feature (12)..(12): n is a, c, g, or t
ccgcccccgccntttgccaacccccccctagcgctttcccgccacccccccccggctctttcgtctagcgaccgacccactggcttggagcagccctgtctcttatccctttaattttcctcatctctggggctgaagcagcttcatttcagagaaaccagctgcttcagaaagaaccagacctcaggttggaaaatgtccaaaagtttcccagtcctgaaatgatcagggctttggagtacatagaaaacctccgacaacaagctcataaggaagaaagcagcccagattataatccctaccaaggtgtctctgtcccccttcagcaaaaagaaaatggcgatgaaagccacttgcccgagagggattcactgagtgaagaagactggatgagaataatactcgaagctttgagacaggctgaaaatgagcctcagtctgcaccaaaagaaaataagccctatgccttgaattcagaaaagaactttccaatggacatgagtgatgattatgagacacagcagtggccagaaagaaagcttaagcacatgcaattccctcctatgtatgaagagaattccagggataacccctttaaacgcacaaatgaaatagtggaggaacaatatactcctcaaagccttgctacattggaatctgtcttccaagagctggggaaactgacaggaccaaacaaccagaaacgtgagaggatggatgaggagcaaaaactttatacggatgatgaagatgatatctacaaggctaataacattgcctatgaagatgtggtcgggggagaagactggaacccagtagaggagaaaatagagagtcaaacccaggaagaggtgagagacagcaaagagaatatagaaaaaaatgaacaaatcaacgatgagatgaaacgctcagggcagcttggcatccaggaagaagatcttcggaaagagagtaaagaccaactctcagatgatgtctccaaagtaattgcctatttgaaaaggttagtaaatgctgcaggaagtgggaggttacagaatgggcaaaatggggaaagggccaccaggctttttgagaaacctcttgattctcagtctatttatcagctgattgaaatctcaaggaatttacagatacccccagaagacttaattgagatgctcaaaactggggagaagccgaatggatcagtggaaccggagcgggagcttgaccttcctgttgacctagatgacatctcagaggctgacttagaccatccagacctgttccaaaataggatgctctccaagagtggctaccctaaaacacctggtcgtgctgggactgaggccctaccagacgggctcagtgttgaggatattttaaatcttttagggatggagagtgcagcaaatcagaaaacgtcgtattttcccaatccatataaccaggagaaagttctgccaaggctcccttatggtgctggaagatctagatcgaaccagcttcccaaagctgcctggattccacatgttgaaaacagacagatggcatatgaaaacctgaacgacaaggatcaagaattaggtgagtacttggccaggatgctagttaaataccctgagatcattaattcaaaccaagtgaagcgagttcctggtcaaggctcatctgaagatgacctgcaggaagaggaacaaattgagcaggccatcaaagagcatttgaatcaaggcagctctcaggagactgacaagctggccccggtgagcaaaaggttccctgtggggcccccgaagaatgatgataccccaaataggcagtactgggatgaagatctgttaatgaaagtgctggaatacctcaaccaagaaaaggcagaaaagggaagggagcatattgctaagagagcaatggaaaatatgtaagctgctttcattaattaccctactttcattcctcccaccccaagcaaatcccaacatttctcttcagtgtgttgacttctatcctgttaacactgtaatatctttaaatgatgtacaggcagatgaaaccaggtcactggggagtctgcttcatttcctctgagctgttatcttgtgtatggatatgtgtaaatgttatgactccttgataaaaaatttattatgtccattattcaagaaagatatctatgactgtgtttaatagtatatctaatggctgtggcattgttgatgctcacatatgataaaaaagtgtcctataattctattgaaagtttttaatatttattgaattattttgttactgtctgtagtgttttgtggagtactggaccaaaaaaataaagcattataaatatatagttttatttataaggccttttctattgtgtgttttactgttgattaataaatgttatttctggacaaaaaaaaaaaatatgcctggagcgcatacatccatgggcgcggttccgcgggtgggg

SEQ ID NO: 301145 - DNA, 2274 bp, Homo sapiens
gtgcggagtcaggcgcagcggctccctataagcagaggagctgtccgtgtgctgaaacggcccgagaagctcgcccggagaacggggaggaatatgctgtggagctcctctgccatataaacaaaaagaggaaatctttcaaacatggctgaagcaaagacccactggcttggagcagccctgtctcttatccctttaattttcctcatctctggggctgaagcagcttcatttcagagaaaccagctgcttcagaaagaaccagacctcaggttggaaaatgtccaaaagtttcccagtcctgaaatgatcagggctttggagtacatagaaaacctccgacaacaaaagaaagcttaagcacatgcaattccctcctatgtatgaagagaattccagggataacccctttaaacgcacaaatgaaatagtggaggaacaatatactcctcaaagccttgctacattggaatctgtcttccaagagctggggaaactgacaggaccaaacaaccagaaacgtgagaggatggatgaggagcaaaaactttatacggatgatgaagatgatatctacaaggctaataacattgcctatgaagatgtggtcgggggagaagactggaacccagtagaggagaaaatagagagtcaaacccaggaagaggtgagagacagcaaagagaatatagaaaaaaatgaacaaatcaacgatgagatgaaacgctcagggcagcttggcatccaggaagaagatcttcggaaagagagtaaagaccaactctcagatgatgtctccaaagtaattgcctatttgaaaaggttagtaaatgctgcaggaagtgggaggttacagaatgggcaaaatggggaaagggccaccaggctttttgagaaacctcttgattctcagtctatttatcagctgattgaaatctcaaggaatttacagatacccccagaagacttaattgagatgctcaaaactggggagaagccgaatggatcagtggaaccggagcgggagcttgaccttcctgttgacctagatgacatctcagaggctgacttagaccatccagacctgttccaaaataggatgctctccaagagtggctaccctaaaacacctggtcgtgctgggactgaggccctaccagacgggctcagtgttgaggatattttaaatcttttagggatggagagtgcagcaaatcagaaaacgtcgtattttcccaatccatataaccaggagaaagttctgccaaggctcccttatggtgctggaagatctagatcgaaccagcttcccaaagctgcctggattccacatgttgaaaacagacagatggcatatgaaaacctgaacgacaaggatcaagaattaggtgagtacttggccaggatgctagttaaataccctgagatcattaattcaaaccaagtgaagcgagttcctggtcaaggctcatctgaagatgacctgcaggaagaggaacaaattgagcaggccatcaaagagcatttgaatcaaggcagctctcaggagactgacaagctggccccggtgagcaaaaggttccctgtggggcccccgaagaatgatgataccccaaataggcagtactgggatgaagatctgttaatgaaagtgctggaatacctcaaccaagaaaaggcagaaaagggaagggagcatattgctaagagagcaatggaaaatatgtaagctgctttcattaattaccctactttcattcctcccaccccaagcaaatcccaacatttctcttcagtgtgttgacttctatcctgttaacactgtaatatctttaaatgatgtacaggcagatgaaaccaggtcactggggagtctgcttcatttcctctgagctgttatcttgtgtatggatatgtgtaaatgttatgactccttgataaaaaatttattatgtccattattcaagaaagatatctatgactgtgtttaatagtatatctaatggctgtggcattgttgatgctcacatatgataaaaaagtgtcctataattctattgaaagtttttaatatttattgaattattttgttactgtctgtagtgttttgtggagtactggaccaaaaaaataaagcattataaatatatagttttatttataaggccttttctattgtgtgttttactgttgattaataaatgttatttctggacaaaaaaaaaaaatatgcctggagcgcatacatccatgggcgcggttccgcgggtgggg

SEQ ID NO: 301146 - DNA, 2209 bp, Homo sapiens
gtgcggagtcaggcgcagcggctccctataagcagaggagctgtccgtgtgctgaaacggcccgagaagctcgcccggagaacggggaggaatatgctgtggagctcctctgccatataaacaaaaagaggaaatctttcaaacatggctgaagcaaagacccactggcttggagcagccctgtctcttatccctttaattttcctcatctctggggctgaagcagcttcatttcagagaaaccagctgcttcagaaagaaccagacctcaggttggaaaatgtccaaaagtttcccagtcctgaaatgatcagggctttggagtacatagaaaacctccgacaacaaaacgcacaaatgaaatagtggaggaacaatatactcctcaaagccttgctacattggaatctgtcttccaagagctggggaaactgacaggaccaaacaaccagaaacgtgagaggatggatgaggagcaaaaactttatacggatgatgaagatgatatctacaaggctaataacattgcctatgaagatgtggtcgggggagaagactggaacccagtagaggagaaaatagagagtcaaacccaggaagaggtgagagacagcaaagagaatatagaaaaaaatgaacaaatcaacgatgagatgaaacgctcagggcagcttggcatccaggaagaagatcttcggaaagagagtaaagaccaactctcagatgatgtctccaaagtaattgcctatttgaaaaggttagtaaatgctgcaggaagtgggaggttacagaatgggcaaaatggggaaagggccaccaggctttttgagaaacctcttgattctcagtctatttatcagctgattgaaatctcaaggaatttacagatacccccagaagacttaattgagatgctcaaaactggggagaagccgaatggatcagtggaaccggagcgggagcttgaccttcctgttgacctagatgacatctcagaggctgacttagaccatccagacctgttccaaaataggatgctctccaagagtggctaccctaaaacacctggtcgtgctgggactgaggccctaccagacgggctcagtgttgaggatattttaaatcttttagggatggagagtgcagcaaatcagaaaacgtcgtattttcccaatccatataaccaggagaaagttctgccaaggctcccttatggtgctggaagatctagatcgaaccagcttcccaaagctgcctggattccacatgttgaaaacagacagatggcatatgaaaacctgaacgacaaggatcaagaattaggtgagtacttggccaggatgctagttaaataccctgagatcattaattcaaaccaagtgaagcgagttcctggtcaaggctcatctgaagatgacctgcaggaagaggaacaaattgagcaggccatcaaagagcatttgaatcaaggcagctctcaggagactgacaagctggccccggtgagcaaaaggttccctgtggggcccccgaagaatgatgataccccaaataggcagtactgggatgaagatctgttaatgaaagtgctggaatacctcaaccaagaaaaggcagaaaagggaagggagcatattgctaagagagcaatggaaaatatgtaagctgctttcattaattaccctactttcattcctcccaccccaagcaaatcccaacatttctcttcagtgtgttgacttctatcctgttaacactgtaatatctttaaatgatgtacaggcagatgaaaccaggtcactggggagtctgcttcatttcctctgagctgttatcttgtgtatggatatgtgtaaatgttatgactccttgataaaaaatttattatgtccattattcaagaaagatatctatgactgtgtttaatagtatatctaatggctgtggcattgttgatgctcacatatgataaaaaagtgtcctataattctattgaaagtttttaatatttattgaattattttgttactgtctgtagtgttttgtggagtactggaccaaaaaaataaagcattataaatatatagttttatttataaggccttttctattgtgtgttttactgttgattaataaatgttatttctggacaaaaaaaaaaaatatgcctggagcgcatacatccatgggcgcggttccgcgggtgggg

SEQ ID NO: 301147 - DNA, 5313 bp, Homo sapiens
gtgaattatgattttccttagtcagaagcactcatttttacccatgtagaccatccttaggaattaaatattggttatttaatgtagattataatgggaagctgatttttttcacaatggcatatttcaaggacttggttccaaactgagctgaagcttcccaatgcgttttgtacagtctgggaaaaactgtgctgcactggcccacttttgaaggccatcatgctctgtaatataaggatatcatcttattgctgatatctttggagagtccctagcagacacagaaaatgaatggaggcaaagagtgtgacggaggggacaaggaaggaggtcttccagctatacaagttcctgtgggttggcagcgtcgtgtggatcaaaatggagtgctttatgtcagtcccagtgggtctttgttatcttgcttggagcaggttaaaacatacctgcttactgatggaacatgcaagtgtggcttggaatgtcctcttattcttcccaaggtatttaattttgatcctggagctgctgtgaaacagagaaccgcagaagatgttaaggcagatgaagatgtcacaaagctatgcatacataaaagaaaaattattgcagtggccacacttcataaaagcatggaagccccacatccttctctggtgctcaccagtcccggaggaggaacaaatgcaactccagtagtaccttctcgggcagcaactccaagatcagtaagaaataagtctcatgaaggaattacaaattctgtaatgcctgaatgtaagaatcctttcaagttaatgattggatcatcaaatgccatgggaaggctatatgtacaagaactgcctggaagccaacaacaagaactccaccctgtctacccccgacagagattgggcagcagtgaacatggacagaaatctccattccgtggcagccatggaggcctgcccagcccagcgtcatcaggttcccagatatatggagatggttcaatctctccaaggactgacccacttggaagtcctgatgttttcacaagaagtaatcctggttttcatggagctcccaattctagtcctattcacctgaataggactcctctttctccaccttcagtaatgctacatggttctcctgtacagtcatcctgtgcaatggctggaaggactaatatacctctttccccaaccttgactacaaagagtccagtaatgaaaaaaccaatgtgtaatttttcaactaatatggaaataccacgagcaatgttccaccacaaaccaccccaaggcccacctccccctcctccaccttcttgtgctcttcagaaaaagccattaacatctgagaaagatccacttggcattcttgaccctattcctagtaaaccagtgaatcagaaccctgttatcattaatccaaccagtttccattcaaatgtccactctcaggtacctatgatgaatgtaagcatgcctcctgctgttgttcctttgccaagtaatctcccattgccaactgtaaaacctggtcacatgaatcatgggagtcatgtacaaagagttcagcattcagcttcaacctccctgtccccttctccagtgacatcccccgtgcacatgatggggactggaattggaaggattgaggcatcgccccaaagatcacgctcatcttccacatcatcagatcatggaaatttcatgatgccacctgtaggaccccaggccacttctagtggtattaaggttccacccaggtcaccaaggtcaacaatagggtccccaaggccatcaatgccatcaagcccttctaccaagtccgatggacatcatcagtacaaggatatccctaacccattaattgctggaataagtaatgtactaaataccccaagcagtgcagcttttcctactgcatctgccggaagtagttctgtaaagagtcagcctggtttgctgggaatgcctttaaatcagatcttgaaccagcacaatgctgcctcctttccagcaagtagtttactctcagcagcagccaaagcacagctagcaaatcaaaacaaacttgctggtaacaacagtagcagcagtagcaattctggagctgttgccggcagtggcaacactgaaggacatagcactttaaacaccatgttccctcctactgccaacatgcttctcccaacaggtgaagggcaaagtggtcgagcagcactaagagataagctgatgtctcagcaaaaagacgcattgcggaaaagaaaacaaccacctacgacagtgttgagtttgctcagacagtctcaaatggatagttctgcagttcctaaacctggacctgacttgctaaggaagcagggtcagggttcatttcccatcagttcaatgtctcagttactacagtctatgagttgtcaaagctctcacttgagtagcaatagtaccccgggttgtggggcctcaaatactgctttgccttgctctgctaaccagctgcattttacagatcccagtatgaactctagtgttcttcagaacatacctttaagaggggaagccgtgcactgccacaatgcaaacactaactttgttcacagtaacagtccagtccccaaccaccatcttgcaggtttaataaatcagattcaggctagcgggaactgtgggatgctcagtcagtcgggcatggctttaggaaattccttacatcccaatccacctcagtcaagaatttcaacgtcctccactccagtgataccaaacagcattgttagcagctataatcaaacaagttctgaagcaggcggttcaggaccatcatcctccatagccatagcgggcaccaaccaccctgccatcacaaagacaacatctgttcttcaagatggcgtcatagtcaccactgcagctggaaacccactgcagagtcagctacccattgggagtgattttccttttgttggccaggagcacgcacttcattttccatccaacagcacttcaaacaaccatcttccacaccccttgaaccccagcctcctcagttctctacctatctctttgccagtgaatcaacagcatctcctaaaccagaatctattaaatatcctccagccttcagcaggagaaggtgatatgtcatcaataaacaatactttgagtaaccatcaactgactcatctacagtcgctgttaaacaacaatcagatgtttcctccaaatcagcaacagcagcaacttctccaggggtaccagaatctccaggcgttccaaggacagtccacaattccttgcccagctaacaataaccccatggcttgtctgtttcagaactttcaggtgagaatgcaggaagatgcagctctcctaaacaaaagaataagcactcagcctgggctcacagcacttcctgagaatccaaacactacacttccaccttttcaagatacaccttgtgagttgcaaccgaggattgacccatctcttggtcaacaggtgaaggatggcctcgttgtgggtggcccaggtgatgcttccgtagatgccatttacaaagcagttgtcgatgcagccagcaaaggaatgcaggttgtcatcaccactgcagtcaacagtacaactcagatcagccccattccagctctgagtgccatgagtgccttcactgcctcaattggtgacccattaaatctctccagtgctgtcagtgcggtcattcatggacggaacatgggaggtgttgatcatgatggtaggctgaggaattcaagaggggctcggctgcccaagaatctagaccatgggaaaaatgtgaacgaaggagatgggtttgaatatttcaagtcagcaagttgccacacatccaaaaaacagtgggacggggagcaaagccccagaggggagcgaaacaggtggaagtacgaggaatttttagatcatccaggccatatccacagtagtccttgtcatgaaaggcccaacaatgtctctacactgccatttctgcctggggaacagcacccaatactgttaccaccaagaaactgtccaggggataaaattctagaggaaaatttcaggtataataactacaaaagaactatgatgagttttaaggagagactagagaacactgtggaaagatgtgcacacataaatgggaatagacctcgacagagtcggggatttggagagctgctaagcactgcaaagcaagacctggtcctagaggagcagtctccaagttcctcaaatagtttggaaaattctctggtcaaagactacatccattacaatggagactttaatgccaaaagcgttaatgggtgtgtgcctagcccttcagatgctaaaagcattagtagtgaagatgacctaaggaacccagactccccctcttcaaatgaattgatacattatagaccaaggacgttcaatgttggcgacttggtctggggccaaatcaaaggactgacttcctggcctggaaaattagtaagagaagacgacgttcacaattcatgtcaacaaagccccgaggaagggaaggtggagcccgagaagttgaagacactaacagaaggtttggaagcctacagccgtgtccggaaaaggaacagaaaaagtggaaagctaaataaccatttagaagctgctattcatgaggccatgagtgaactggacaaaatgtctgggactgtacaccaaatcccacagggtgacagacaaatgagaccccccaaacccaagaggaggaagatctccagataacagagactactccactaatgcgcagtgtttattaaaggaacatgcacagatgtatctgtatataggtattgatatagccacagttatatcaatatttagactatggcagatagctaccaccaccacagggtgctaaaagaaacagtgatacaaaatttttttgatcaggaaggataatgaatgctggaaaagccaatcaaagtctctgtgtgatgagagtgatcaatggtcaagagattactgagaaactctttttctataatactaaattgtgattataagaaatagtccaaatgtttctgaagaattttcaatgttgtatatagaaaatacagaatttcatggtgatatcagaaatgtaaatattgtacagtattgtcatgtacaagcgtacctaatgcacactttatcttttattgtacaaagaaatagtgtacaaaattctttggtttctatggagtacacctaccagagactaccagtgtaaagtgataaataaaaatacaacctaaatgcttttctatgaaaatgtaaaaga

SEQ ID NO: 301148 - DNA, 551 bp, Homo sapiens
gaggacccccagccaataacctcccaagacctggtcctagaggagcagtctccaagttcctcaaatagtttggaaaattctctggtcaaagactacatccattacaatggagactttaatgccaaaagcgttaatgggtgtgtgcctagcccttcagatgctaaaagcattagtagtgaagatgacctaaggaacccagactccccctcttcaaatgaattgatacattatagaccaaggacgttcaatgttggcgacttggtctggggccaaatcaaaggactgacttcctggcctggaaaattagtaagagaagacgacgttcacaattcatgtcaacaaagccccgaggaagggaaggtataccaatctttatccattgtcaaatactaacctttgttcagatatcaattattgctttttgttatcatcactttggattctttggatttgaaattaggattcttcatgactcattgaggtctcacaagcttctggagcataaaatgaagaggggatggttatagtcaacaaaatgtcgtatcaacaag

SEQ ID NO: 301149 - DNA, 3472 bp, Homo sapiens
gtgaattatgattttccttagtcagaagcactcatttttacccatgtagaccatccttaggaattaaatattggttatttaatgtagattataatgggaagctgatttttttcacaatggcatatttcaaggacttggttccaaactgagctgaagcttcccaatgcgttttgtacagtctgggaaaaactgtgctgcactggcccacttttgaaggccatcatgctctgtaatataaggatatcatcttattgctgatatctttggagagtccctagcagacacagaaaatgaatggaggcaaagagtgtgacggaggggacaaggaaggaggtcttccagctatacaagttcctgtgggttggcagcgtcgtgtggatcaaaatggagtgctttatgtcagtcccagtgggtctttgttatcttgcttggagcaggttaaaacatacctgcttactgatggaacatgcaagtgtggcttggaatgtcctcttattcttcccaaggtatttaattttgatcctggagctgctgtgaaacagagaaccgcagaagatgttaaggcagatgaagatgtcacaaagctatgcatacataaaagaaaaattattgcagtggccacacttcataaaagcatggaagccccacatccttctctggtgctcaccagtcccggaggaggaacaaatgcaactccagtagtaccttctcgggcagcaactccaagatcagtaagaaataagtctcatgaaggaattacaaattctgtaatgcctgaatgtaagaatcctttcaagttaatgattggatcatcaaatgccatgggaaggctatatgtacaagaactgcctggaagccaacaacaagaactccaccctgtctacccccgacagagattgggcagcagtgaacatggacagaaatctccattccgtggcagccatggaggcctgcccagcccagcgtcatcaggttcccagatatatggagatggttcaatctctccaaggactgacccacttggaagtcctgatgttttcacaagaagtaatcctggttttcatggagctcccaattctagtcctattcacctgaataggactcctctttctccaccttcagtaatgctacatggttctcctgtacagtcatcctgtgcaatggctggaaggactaatatacctctttccccaaccttgactacaaagagtccagtaatgaaaaaaccaatgtgtaatttttcaactaatatggaaataccacgagcaatgttccaccacaaaccaccccaaggcccacctccccctcctccaccttcttgtgctcttcagaaaaagccattaacatctgagaaagatccacttggcattcttgaccctattcctagtaaaccagtgaatcagaaccctgttatcattaatccaaccagtttccattcaaatgtccactctcaggtacctatgatgaatgtaagcatgcctcctgctgttgttcctttgccaagtaatctcccattgccaactgtaaaacctggtcacatgaatcatgggagtcatgtacaaagagttcagcattcagcttcaacctccctgtccccttctccagtgacatcccccgtgcacatgatggggactggaattggaaggattgaggcatcgccccaaagatcacgctcatcttccacatcatcagatcatggaaatttcatgatgccacctgtaggaccccaggccacttctagtggtattaaggttccacccaggtcaccaaggtcaacaatagggtccccaaggccatcaatgccatcaagcccttctaccaagtccgatggacatcatcagtacaaggatatccctaacccattaattgctggaataagtaatgtactaaataccccaagcagtgcagcttttcctactgcatctgccggaagtagttctgtaaagagtcagcctggtttgctgggaatgcctttaaatcagatcttgaaccagcacaatgctgcctcctttccagcaagtagtttactctcagcagcagccaaagcacagctagcaaatcaaaacaaacttgctggtaacaacagtagcagcagtagcaattctggagctgttgccggcagtggcaacactgaaggacatagcactttaaacaccatgttccctcctactgccaacatgcttctcccaacaggtgaagggcaaagtggtcgagcagcactaagagataagctgatgtctcagcaaaaagacgcattgcggaaaagaaaacaaccacctacgacagtgttgagtttgctcagacagtctcaaatggatagttctgcagttcctaaacctggacctgacttgctaaggaagcagggtcagggttcatttcccatcagttcaatgtctcagttactacagtctatgagttgtcaaagctctcacttgagtagcaatagtaccccgggttgtggggcctcaaatactgctttgccttgctctgctaaccagctgcattttacagatcccagtatgaactctagtgttcttcagaacatacctttaagaggggaagccgtgcactgccacaatgcaaacactaactttgttcacagtaacagtccagtccccaaccaccatcttgcaggtttaataaatcagattcaggctagcgggaactgtgggatgctcagtcagtcgggcatggctttaggaaattccttacatcccaatccacctcagtcaagaatttcaacgtcctccactccagtgataccaaacagcattgttagcagctataatcaaacaagttctgaagcaggtatggttttattagaaaaaagtacccaaaggtactaaacttttctacttttttaaaaaatttgtaccaaaatatttattatgataagaaatgatcctttccccattgtgaaattctcttcatttctttagtatttataattttatttacagaatgctagggatttgtctattgggaagattaacagctaagaggatttcatgtgtttccattatttgttgtcaatctgtgtcattttgaatattgttcgactttcacttggttttataaccattggactccaaactgcaaaataagccatacgaggcagggtttcctggtttgtgagacatgtccttggtctatgccaatataaaagccatctccctagcttttgtttgtattcaggtaaatgaagtttatcttggaaaaatccaaaaaggcaaaaataaatggattttttttcttgctgctgaacagaagtaggtgaatggataggaaaaggtaactagaagttgtacgaagtagaaggctgtcttctaatgtgttttcttatcctagtttgctatccttattatttgtttgagaaaactcaaaaatggatattggctactcccttttaaaaaaaaagctaataatttaagctttctaataaaaaaaaggcttgaaaacctgatttccagaa

SEQ ID NO: 301150 - DNA, 465 bp, Homo sapiens
ctgaagcttcccaatgcgttttgtacagtctgggaaaaactgtgctgcactggcccacttttgaaggccatcatgctctgtaatataaggatatcatcttattgctgatatctttggagagtccctagcagacacagaaaatgaatggaggcaaagagtgtgacggaggggacaaggaaggaggtcttccagctatacaagttcctgtgggttggcagcgtcgtgtggatcaaaatggagtgctttatgtcaggtaagttcttattattacctgtggtacctgcaaagttgtactccaaagactaaggagagaaccaagcatggtgactgatggcacctcatataaatgtgaaaaagtgacctttgtgctagaaacatatgagaatttttattgccttagatttccagagagaattttttgcattacttgtttatataaggtgtcattctgcttatctctgtaac

SEQ ID NO: 301151 - DNA, 472 bp, Homo sapiens
agccagggagcatgaggggcgtctctgggagagggaacccgtggcccaactttcttcccaaatcaccagattgtggaagaagcatgtggaagaggaaaaagtccatctccccgccccacaatctgttcaactttttttagtagttctgtgactttaatcattagtattcagtgataagaatcccagagtgatgttttgtcatctgaattttccaaacgcgagtataaattggctttctctcgtggaattggtacttttgttttctgattaggaaattaaattgagttttgtttctttaattttttaatctggtgtgttgttttcattaattccagaagtggaaagctaaataaccatttagaagctgctattcatgaggccatgagtgaactggacaaaatgtctgggactgtaagttaatttatttttccattatactacgtttctttgaaaataaattgtgttacacttt

SEQ ID NO: 301152 - DNA, 2372 bp, Homo sapiens
ttaatattgttgccctaggtttcttttgtttaatatttgtctggattgcctgttcccataaattgacctttaatcagttagctttgttcttaagattggtttaaaacgtagaataatagggaggagcatgggagggtgggacgtctaatgtaaatccagcccagtgattacattagctgggcgctgattaggttaggatgttgcccaggtacaaggccaggatcttcgggacctggcttcatttggagttcagctaccaaaaggaaaccttcctctgggtcctggagtatttggcctgaaattgggaactcggaagttgctgctccagggcgctccctgcggagctccgccgcccgcctctccgcccggcctttcccggcgtccccacgcggggcgcaaccgcgagaaagaaacgcaggtcgcaccgtcagcgcccagagcagcgccagtttccgggcccgggctgctctcggagccatgagctgcggccgcccccctcccgacgtggacggcatgatcaccctcaaggtggacaacctgacctaccgcacctctcccgacagcttgaggcgcgtgttcgagaagtacgggcgcgtgggcgacgtgtacatcccgcgggagccccacaccaaggcgccccggggcttcgctttcgtccgctttcacgaccggcgcgacgcccaagacgccgaggccgccatggacggggcggagctggacggacgcgagctgcgggtgcaggtggcgcgctatggccgccgggacctgccccgcagccgccagggagagccacgcggcaggtccagaggcggcggctacggacggcggagccgcagctacgggcggcggagccgcagccccaggcggcgacaccgcagccgatcccggggtcccagctgctccaggtcccgcagccgatctcgctataggggttctcgctatagccggtctccctacagccgatctccttacagccggtcgcgctacagccgctctccctacagcagatctcgctacagggaatctcgctacggcggatctcactacagctcatctggttacagtaactctcgctacagccgatatcacagcagccggtctcactcgaagtctgggtcctccactagctctcgctctgcatcaacctccaaatcgagctctgcgcgacgatccaagtcctcctcggtctccaggtctcgctcgcggtccaggtcttcatctatgaccaggagtcctccccgggtatccaagaggaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctggaagaagaggctgcctattgaaaaggttgtgtcacacttttctacctttttgccagtttgaagctttgcatcaggtggcaaaattcattctatgtgccgttttgttgttattcacattttattgtaacttaggaggtgaacgacctaagattacgttattgggtttggatatttgaggcaaaaatttatttttatttctatagtgatgactgttttggtttgaaatgaacagattggtaacctaatttgtggcctcctgacttttaaggaaacgtgtgcagccattacacacagcctaacgctgtcaagacattgcttcaacattgccttcattccttaaaaacctacaaaaggtggtgtaaattaatatggataattttatttacctccaggtctaaaaggtagtgtgacccaaatttgtataaagatttttcatgtgaaaggactggggttttagcaaacacaggtctaatctcttttgtgtttttgtgcaccaggcccggctgcgtagcagttgagtgatgctggttagctattaaggtggcctgttgcagtgcagagtgctgagctgcttcctgttttcttctgattgctcctggggaaaacacgccttgtcctgaagaacaaatggctgtccagtttattaaaatgcctgtcaactgcacttccagtcacccaggccttgcagataaataatggagcatgcagtgagcacatctagctgacgataatcacaccttttcccccgtcttttctgaaaaattgtaaatctgatcatatcaacatgtatgaacttaaaatatggagaatgttatggaagaaatagtttataagtttgttaagtacttataacatggtttatctttttgattattaattttttacgctaaccattgtttctgtagttaaaattgttttcttggtgttatcttttctcagaataaaattagaaacttttgatgg

SEQ ID NO: 301153 - DNA, 334 bp, Homo sapiens
  misc_feature (52)..(53): n is a, c, g, or t
  misc_feature (73)..(73): n is a, c, g, or t
tcaggttatctagaggatcccggtcatcttgtctacacccatcaccacgccnngtcttccccaactcactaancagcaccgtcatccatttagcatttcaagccagtgagaagtcatcatttataagtgcatttctaaaaatattgcttaattttgtttttgagctttgtataagtggaattttgtgtgtactgattattttgctcaatactatgtctttaagattctctgtattgttgcatgtggctgagtttatttttgatgctgtgtagtgttttactaattaataaatcataattcagtttttactgttctattgatggaaaaaagggtt

SEQ ID NO: 301154 - DNA, 4493 bp, Homo sapiens
ttaatattgttgccctaggtttcttttgtttaatatttgtctggattgcctgttcccataaattgacctttaatcagttagctttgttcttaagattggtttaaaacgtagaataatagggaggagcatgggagggtgggacgtctaatgtaaatccagcccagtgattacattagctgggcgctgattaggttaggatgttgcccaggtacaaggccaggatcttcgggacctggcttcatttggagttcagctaccaaaaggaaaccttcctctgggtcctggagtatttggcctgaaattgggaactcggaagttgctgctccagggcgctccctgcggagctccgccgcccgcctctccgcccggcctttcccggcgtccccacgcggggcgcaaccgcgagaaagaaacgcaggtcgcaccgtcagcgcccagagcagcgccagtttccgggcccgggctgctctcggagccatgagctgcggccgcccccctcccgacgtggacggcatgatcaccctcaaggtggacaacctgacctaccgcacctctcccgacagcttgaggcgcgtgttcgagaagtacgggcgcgtgggcgacgtgtacatcccgcgggagccccacaccaaggcgccccggggcttcgctttcgtccgctttcacgaccggcgcgacgcccaagacgccgaggccgccatggacggggcggagctggacggacgcgagctgcgggtgcaggtggcgcgctatggccgccgggacctgccccgcagccgccagggagagccacgcggcaggtccagaggcggcggctacggacggcggagccgcagctacgggcggcggagccgcagccccaggcggcgacaccgcagccgatcccggggtcccagctgctccaggtcccgcagccgatctcgctataggggttctcgctatagccggtctccctacagccgatctccttacagccggtcgcgctacagccgctctccctacagcagatctcgctacagggaatctcgctacggcggatctcactacagctcatctggttacagtaactctcgctacagccgatatcacagcagccggtctcactcgaagtctgggtcctccactagctctcgctctgcatcaacctccaaatcgagctctgcgcgacgatccaagtcctcctcggtctccaggtctcgctcgcggtccaggtcttcatctatgaccaggagtcctccccgggtatccaagaggaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctggaagaagaggctgcctattgaaaaggttgtgtcacacttttctacctttttgccagtttgaagctttgcatcaggtggcaaaattcattctatgtgccgttttgttgttattcacattttattgtaacttaggaggtgaacgacctaagattacgttattgggtttggatatttgaggcaaaaatttatttttatttctatagtgatgactgttttggtttgaaatgaacagattggtaacctaatttgtggcctcctgacttttaaggaaacgtgtgcagccattacacacagcctaacgctgtcaagacattgcttcaacattgccttcattccttaaaaacctacaaaaggtggtgtaaattaatatggataattttatttacctccaggtctaaaaggtagtgtgacccaaatttgtataaagatttttcatgtgaaaggactggggttttagcaaacacaggtctaatctcttttgtgtttttgtgcaccaggcccggctgcgtagcagttgagtgatgctggttagctattaaggtggcctgttgcagtgcagagtgctgagctgcttcctgttttcttctgattgctcctggggaaaacacgccttgtcctgaagaacaaatggctgtccagtttattaaaatgcctgtcaactgcacttccagtcacccaggccttgcagataaataatggagcatgcagtgagcacatctagctgacgataatcacaccttttcccccgtcttttctgaaaaattgtaaatctgatcatatcaacatgtatgaacttaaaatatggagaatgttatggaagaaatagtttataagtttgttaagtacttataacatggtttatctttttgattattaattttttacgctaaccattgtttctgtagttaaaattgttttcttggtgttatcttttctcagaataaaattagaaacttttgatggaaagtaggttgttttattttctgtatgacttttggatatttgtacttttgagaaaattattagcaccaagtgtttctcaaaatataatttttaaaaaatccttaataggcttttagctatgtgctttattgttttatcacaatgcagtttatttgtagtttctctcttttttcctcacacctatggtttttttacttccaaaattattttcaaataatccatttttggctttcatcattatccctactagatgttatgtgttcttttgcaattgtttctgcttatacctttactagcaaagggaaaaataacaatttggtgtcaatgatctggtgacaataggattacattggagccaattgaataaatttattctttcaatcatatggatcttcattaatatttttgactgaattatcaattaaaaatatttcattccctttgtgcagaaactgctaaatccagggttcgattcttgaatgaactggcaagctggctgtggtctgtagatatacatcccacattttgttgttataacagttagtagttagtattgctttcatatatagactccagaatctaaattttacgataatgacatttcttctggtcatgacaaatgtaatattttacaaatataaatctacgtagaatccaaagacacacacggagcagtcctgtctgagaaataaaaaatcaggacacccatggcatcgtagtagcccctcgcgtccagcaggtggcgaagggaggtgaggtttatttattaaatgggaccgagtgggacggggacggggcagccctaagggtagggaagcattgtcaatttctggggatagaatgagacccaggcatagctggagtttgaagctttgaagcaaaaatatctgtagaacatcttaaacgtgaccaaaatatgatgttaaaatcagcaactctttatacgttaaaaactttgaaacctgtggccgggcatggtggctcgcgcctgtaatcccagcactttgggaggccaaggcaggtggatcacctgaggtcaggagctcaagaccagcctgaccaacatggtgaaaccccgtctctactaaaaatacaaaaattagctgggcatggtggcgcatgcctataatcccagctactcggaggctgaggcaggataatcgcttgaaaccgggagacagaggttgtggtgagccgagatcacgccattgcactccagccggggcaacaagagcaaaacttcatctcaaaaaaaaaaaataaaaaaaaagaaaaaggaaaaaaacaaacaaacaacaactttgaaacctaggaacaattttggacctgttggagcagaaatgtgtagttgtcattgaaggtgtgaacataccctacctctactctacatgtggaagacctgacccacagaggacatgaacccatgaagaagagtgatgtgacatgttttgcattttattagtaccatgatctaaccaactgagctaactggccacaccattttatcctttataatgatcactatgagggctgagtgcagaatggagtgtatgtggtcaagagtggaagctgtgaggctattgcagtaatccagaaagaaaggtgacaatggcttagacttcagtggtagtgttggaaatggacataaatagacatattcaggaaatatattgatcttagatctaataagacacgtaatagattagaagtagggaaattaatgaaaaagcagaattaaggatgacttctcactggcttgaaatgctaaatggatgacggtgctgtttagtgagttggggaagactgggcgtggtgatgggtgtagaaattgagaaaggaaaatcaagaatttccagaactttcagagcaatgttaaatactttccttgatagtgggtcagtcatcatttataagtgcatttctaaaaatattgcttaattttgtttttgagctttgtataagtggaattttgtgtgtactgattattttgctcaatactatgtctttaagattctctgtattgttgcatgtggctgagtttatttttgatgctgtgtagtgttttactaattaataaatcataattcagtttttactgttctattgatggaaaaaagggtt

SEQ ID NO: 301155 - DNA, 4358 bp, Homo sapiens
ttaatattgttgccctaggtttcttttgtttaatatttgtctggattgcctgttcccataaattgacctttaatcagttagctttgttcttaagattggtttaaaacgtagaataatagggaggagcatgggagggtgggacgtctaatgtaaatccagcccagtgattacattagctgggcgctgattaggttaggatgttgcccaggtacaaggccaggatcttcgggacctggcttcatttggagttcagctaccaaaaggaaaccttcctctgggtcctggagtatttggcctgaaattgggaactcggaagttgctgctccagggcgctccctgcggagctccgccgcccgcctctccgcccggcctttcccggcgtccccacgcggggcgcaaccgcgagaaagaaacgcaggtcgcaccgtcagcgcccagagcagcgccagtttccgggcccgggctgctctcggagccatgagctgcggccgcccccctcccgacgtggacggcatgatcaccctcaaggtggacaacctgacctaccgcacctctcccgacagcttgaggcgcgtgttcgagaagtacgggcgcgtgggcgacgtgtacatcccgcgggagccccacaccaaggcgccccggggcttcgctttcgtccgctttcacgaccggcgcgacgcccaagacgccgaggccgccatggacggggcggagctggacggacgcgagctgcgggtgcaggtggcgcgctatggccgccgggacctgccccgcagccgccagggagagccacgcggcaggtccagaggcggcggctacggacggcggagccgcagctacgggcggcggagccgcagccccaggcggcgacaccgcagccgatcccggggtcccagctgctccaggtcccgcagccgatctcgctataggggttctcgctatagccggtctccctacagccgatctccttacagccggtcgcgctacagccgctctccctacagcagatctcgctacagggaatctcgctacggcggatctcactacagctcatctggttacagtaactctcgctacagccgatatcacagcagccggtctcactcgaagtctgggtcctccactagctctcgctctgcatcaacctccaaatcgagctctgcgcgacgatccaagtcctcctcggtctccaggtctcgctcgcggtccaggtcttcatctatgaccaggagtcctccccgggtatccaagaggaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctggaagaagaggctgcctattgaaaaggttgtgtcacacttttctacctttttgccagtttgaagctttgcatcaggtggcaaaattcattctatgtgccgttttgttgttattcacattttattgtaacttaggaggtgaacgacctaagattacgttattgggtttggatatttgaggcaaaaatttatttttatttctatagtgatgactgttttggtttgaaatgaacagattggtaacctaatttgtggcctcctgacttttaaggaaacgtgtgcagccattacacacagcctaacgctgtcaagacattgcttcaacattgccttcattccttaaaaacctacaaaaggtggtgtaaattaatatggataattttatttacctccaggtctaaaaggtagtgtgacccaaatttgtataaagatttttcatgtgaaaggactggggttttagcaaacacaggtctaatctcttttgtgtttttgtgcaccaggcccggctttattaaaatgcctgtcaactgcacttccagtcacccaggccttgcagataaataatggagcatgcagtgagcacatctagctgacgataatcacaccttttcccccgtcttttctgaaaaattgtaaatctgatcatatcaacatgtatgaacttaaaatatggagaatgttatggaagaaatagtttataagtttgttaagtacttataacatggtttatctttttgattattaattttttacgctaaccattgtttctgtagttaaaattgttttcttggtgttatcttttctcagaataaaattagaaacttttgatggaaagtaggttgttttattttctgtatgacttttggatatttgtacttttgagaaaattattagcaccaagtgtttctcaaaatataatttttaaaaaatccttaataggcttttagctatgtgctttattgttttatcacaatgcagtttatttgtagtttctctcttttttcctcacacctatggtttttttacttccaaaattattttcaaataatccatttttggctttcatcattatccctactagatgttatgtgttcttttgcaattgtttctgcttatacctttactagcaaagggaaaaataacaatttggtgtcaatgatctggtgacaataggattacattggagccaattgaataaatttattctttcaatcatatggatcttcattaatatttttgactgaattatcaattaaaaatatttcattccctttgtgcagaaactgctaaatccagggttcgattcttgaatgaactggcaagctggctgtggtctgtagatatacatcccacattttgttgttataacagttagtagttagtattgctttcatatatagactccagaatctaaattttacgataatgacatttcttctggtcatgacaaatgtaatattttacaaatataaatctacgtagaatccaaagacacacacggagcagtcctgtctgagaaataaaaaatcaggacacccatggcatcgtagtagcccctcgcgtccagcaggtggcgaagggaggtgaggtttatttattaaatgggaccgagtgggacggggacggggcagccctaagggtagggaagcattgtcaatttctggggatagaatgagacccaggcatagctggagtttgaagctttgaagcaaaaatatctgtagaacatcttaaacgtgaccaaaatatgatgttaaaatcagcaactctttatacgttaaaaactttgaaacctgtggccgggcatggtggctcgcgcctgtaatcccagcactttgggaggccaaggcaggtggatcacctgaggtcaggagctcaagaccagcctgaccaacatggtgaaaccccgtctctactaaaaatacaaaaattagctgggcatggtggcgcatgcctataatcccagctactcggaggctgaggcaggataatcgcttgaaaccgggagacagaggttgtggtgagccgagatcacgccattgcactccagccggggcaacaagagcaaaacttcatctcaaaaaaaaaaaataaaaaaaaagaaaaaggaaaaaaacaaacaaacaacaactttgaaacctaggaacaattttggacctgttggagcagaaatgtgtagttgtcattgaaggtgtgaacataccctacctctactctacatgtggaagacctgacccacagaggacatgaacccatgaagaagagtgatgtgacatgttttgcattttattagtaccatgatctaaccaactgagctaactggccacaccattttatcctttataatgatcactatgagggctgagtgcagaatggagtgtatgtggtcaagagtggaagctgtgaggctattgcagtaatccagaaagaaaggtgacaatggcttagacttcagtggtagtgttggaaatggacataaatagacatattcaggaaatatattgatcttagatctaataagacacgtaatagattagaagtagggaaattaatgaaaaagcagaattaaggatgacttctcactggcttgaaatgctaaatggatgacggtgctgtttagtgagttggggaagactgggcgtggtgatgggtgtagaaattgagaaaggaaaatcaagaatttccagaactttcagagcaatgttaaatactttccttgatagtgggtcagtcatcatttataagtgcatttctaaaaatattgcttaattttgtttttgagctttgtataagtggaattttgtgtgtactgattattttgctcaatactatgtctttaagattctctgtattgttgcatgtggctgagtttatttttgatgctgtgtagtgttttactaattaataaatcataattcagtttttactgttctattgatggaaaaaagggtt

SEQ ID NO: 301156 - DNA, 4439 bp, Homo sapiens
ttaatattgttgccctaggtttcttttgtttaatatttgtctggattgcctgttcccataaattgacctttaatcagttagctttgttcttaagattggtttaaaacgtagaataatagggaggagcatgggagggtgggacgtctaatgtaaatccagcccagtgattacattagctgggcgctgattaggttaggatgttgcccaggtacaaggccaggatcttcgggacctggcttcatttggagttcagctaccaaaaggaaaccttcctctgggtcctggagtatttggcctgaaattgggaactcggaagttgctgctccagggcgctccctgcggagctccgccgcccgcctctccgcccggcctttcccggcgtccccacgcggggcgcaaccgcgagaaagaaacgcaggtcgcaccgtcagcgcccagagcagcgccagtttccgggcccgggctgctctcggagccatgagctgcggccgcccccctcccgacgtggacggcatgatcaccctcaaggtggacaacctgacctaccgcacctctcccgacagcttgaggcgcgtgttcgagaagtacgggcgcgtgggcgacgtgtacatcccgcgggagccccacaccaaggcgccccggggcttcgctttcgtccgctttcacgaccggcgcgacgcccaagacgccgaggccgccatggacggggcggagctggacggacgcgagctgcgggtgcaggtggcgcgctatggccgccgggacctgccccgcagccgccagggagagccacgcggcaggtccagaggcggcggctacggacggcggagccgcagctacgggcggcggagccgcagccccaggcggcgacaccgcagccgatcccggggtcccagctgctccaggtcccgcagccgatctcgctataggggttctcgctatagccggtctccctacagccgatctccttacagccggtcgcgctacagccgctctccctacagcagatctcgctacagggaatctcgctacggcggatctcactacagctcatctggttacagtaactctcgctacagccgatatcacagcagccggtctcactcgaagtctgggtcctccactagctctcgctctgcatcaacctccaaatcgagctctgcgcgacgatccaagtcctcctcggtctccaggtctcgctcgcggtccaggtcttcatctatgaccaggagtcctccccgggtatccaagaggaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctggaagaagaggctgcctattgaaaaggttgtgtcacacttttctacctttttgccagtttgaagctttgcatcaggtggcaaaattcattctatgtgccgttttgttgttattcacattttattgtaacttaggaggtgaacgacctaagattacgttattgggtttggatatttgaggcaaaaatttatttttatttctatagtgatgactgttttggtttgaaatgaacagattggtaacctaatttgtggcctcctgacttttaaggaaacgtgtgcagccattacacacagcctaacgctgtcaagacattgcttcaacattgccttcattccttaaaaacctacaaaaggtggtgtaaattaatatggataattttatttacctccaggtctaaaaggtagtgtgacccaaatttgtataaagatttttcatgtgaaaggactggggttttagcaaacacaggtctaatctcttttgtgtttttgtgcaccaggcccggctgcgtagcagttgagtgatgctggttagctattaaggtggcctgttgcagtgcagagtgctgagctgcttcctgttttcttctgattgctcctggggaaaacacgccttgtcctgaagaacaaatggctgtccagtttattaaaatgcctgtcaactgcacttccagtcacccaggccttgcagataaataatggagcatgcagtgagcacatctagctgacgataatcacaccttttcccccgtcttttctgaaaaattgtaaatctgatcatatcaacatgtatgaacttaaaatatggagaatgttatggaagaaatagtttataagtttgttaagtacttataacatggtttatctttttgattattaattttttacgctaaccattgtttctgtagttaaaattgttttcttggtgttatcttttctcagaataaaattagaaacttttgatggaaagtaggttgttttattttctgtatgacttttggatatttgtacttttgagaaaattattagcaccaagtgtttctcaaaatataatttttaaaaaatccttaataggcttttagctatgtgctttattgttttatcacaatgcagtttatttgtagtttctctcttttttcctcacacctatggtttttttacttccaaaattattttcaaataatccatttttggctttcatcattatccctactagatgttatgtgttcttttgcaattgtttctgcttatacctttactagcaaagggaaaaataacaatttggtgtcaatgatctggtgacaataggattacattggagccaattgaataaatttattctttcaatcatatggatcttcattaatatttttgactgaattatcaattaaaaatatttcattccctttgtgcagaaactgctaaatccagggttcgattcttgaatgaactggcaagctggctgtggtctgtagatatacatcccacattttgttgttataacagttagtagttagtattgctttcatatatagactccagaatctaaattttacgataatgacatttcttctggtcatgacaaatgtaatattttacaaatataaatctacgtagaatccaaagacacacacggagcagtcctgtctgagaaataaaaaatcaggacacccatggcatcgtagtagcccctcgcgtccagcaggtggcgaagggaggtgaggtttatttattaaatgggaccgagtgggacggggacggggcagccctaagggtagggaagcattgtcaatttctggggatagaatgagacccaggcatagctggagtttgaagctttgaagcaaaaatatctgtagaacatcttaaacgtgaccaaaatatgatgttaaaatcagcaactctttatacgttaaaaactttgaaacctgtggccgggcatggtggctcgcgcctgtaatcccagcactttgggaggccaaggcaggtggatcacctgaggtcaggagctcaagaccagcctgaccaacatggtgaaaccccgtctctactaaaaatacaaaaattagctgggcatggtggcgcatgcctataatcccagctactcggaggctgaggcaggataatcgcttgaaaccgggagacagaggttgtggtgagccgagatcacgccattgcactccagccggggcaacaagagcaaaacttcatctcaaaaaaaaaaaataaaaaaaaagaaaaaggaaaaaaacaaacaaacaacaactttgaaacctaggaacaattttggacctgttggagcagaaatgtgtagttgtcattgaaggtgtgaacataccctacctctactctacatgtggaagacctgacccacagaggacatgaacccatgaagaagagtgatgtgacatgttttgcattttattagtaccatgatctaaccaactgagctaactggccacaccattttatcctttataatgatcactatgagggctgagtgcagaatggagtgtatgtggtcaagagtggaagctgtgaggctattgcagtaatccagaaagaaaggtgacaatggcttagacttcagtggtagtgttggaaatggacataaatagacatattcaggaaatatattgatcttagatctaataagacacgtaatagattagaagtagggaaattaatgaaaaagcagaattaaggatgacttctcactggcttgaaatgctaaatggatgacggtgctgtttagtgagttggggaagactgggcgtggtgatgggtgtagaaattgagaaaggaaaatcaagaatttccagaactttcagagcaatgttaaatactttccttgatagtgggtcagtcatcatttataagtgcatttgtactgattattttgctcaatactatgtctttaagattctctgtattgttgcatgtggctgagtttatttttgatgctgtgtagtgttttactaattaataaatcataattcagtttttactgttctattgatggaaaaaagggtt

SEQ ID NO: 301157 - DNA, 4262 bp, Homo sapiens
ttaatattgttgccctaggtttcttttgtttaatatttgtctggattgcctgttcccataaattgacctttaatcagttagctttgttcttaagattggtttaaaacgtagaataatagggaggagcatgggagggtgggacgtctaatgtaaatccagcccagtgattacattagctgggcgctgattaggttaggatgttgcccaggtacaaggccaggatcttcgggacctggcttcatttggagttcagctaccaaaaggaaaccttcctctgggtcctggagtatttggcctgaaattgggaactcggaagttgctgctccagggcgctccctgcggagctccgccgcccgcctctccgcccggcctttcccggcgtccccacgcggggcgcaaccgcgagaaagaaacgcaggtcgcaccgtcagcgcccagagcagcgccagtttccgggcccgggctgctctcggagccatgagctgcggccgcccccctcccgacgtggacggcatgatcaccctcaaggtggacaacctgacctaccgcacctctcccgacagcttgaggcgcgtgttcgagaagtacgggcgcgtgggcgacgtgtacatcccgcgggagccccacaccaaggcgccccggggcttcgctttcgtccgctttcacgaccggcgcgacgcccaagacgccgaggccgccatggacggggcggagctggacggacgcgagctgcgggtgcaggtggcgcgctatggccgccgggacctgccccgcagccgccagggagagccacgcggcaggtccagaggcggcggctacggacggcggagccgcagctacgggcggcggagccgcagccccaggcggcgacaccgcagccgatcccggggtcccagctgctccaggtcccgcagccgatctcgctataggggttctcgctatagccggtctccctacagccgatctccttacagccggtcgcgctacagccgctctccctacagcagatctcgctacagggaatctcgctacggcggatctcactacagctcatctggttacagtaactctcgctacagccgatatcacagcagccggtctcactcgaagtctgggtcctccactagctctcgctctgcatcaacctccaaatcgagctctgcgcgacgatccaagtcctcctcggtctccaggtctcgctcgcggtccaggtcttcatctatgaccaggagtcctccccgggtatccaagaggaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctggaagaagaggctgcctattgaaaaggttgtgtcacacttttctacctttttgccagtttgaagctttgcatcaggtggcaaaattcattctatgtgccgttttgttgttattcacattttattgtaacttaggaggtgaacgacctaagattacgttattgggtttggatatttgaggcaaaaatttatttttatttctatagtgatgactgttttggtttgaaatgaacagattggtaacctaatttgtggcctcctgacttttaaggaaacgtgtgcagccattacacacagcctaacgctgtcaagacattgcttcaacattgccttcattccttaaaaacctacaaaaggtggtgtaaattaatatggataattttatttacctccaggtctaaaaggtagtgtgacccaaatttgtataaagatttttcatgtgaaaggactggggttttagcaaacacaggtctaatctcttttgtgtttttgtgcaccaggcccggctgcgtagcagttgagtgatgctggttagctattaaggtggcctgttgcagtgcagagtgctgagctgcttcctgttttcttctgattgctcctggggaaaacacgccttgtcctgaagaacaaatggctgtccagtttattaaaatgcctgtcaactgcacttccagtcacccaggccttgcagataaataatggagcatgcagtgagcacatctagctgacgataatcacaccttttcccccgtcttttctgaaaaattgtaaatctgatcatatcaacatgtatgaacttaaaatatggagaatgttatggaagaaatagtttataagtttgttaagtacttataacatggtttatctttttgattattaattttttacgctaaccattgtttctgtagttaaaattgttttcttggtgttatcttttctcagaataaaattagaaacttttgatggaaagtaggttgttttattttctgtatgacttttggatatttgtacttttgagaaaattattagcaccaagtgtttctcaaaatataatttttaaaaaatccttaataggcttttagctatgtgctttattgttttatcacaatgcagtttatttgtagtttctctcttttttcctcacacctatggtttttttacttccaaaattattttcaaataatccatttttggctttcatcattatccctactagatgttatgtgttcttttgcaattgtttctgcttatacctttactagcaaagggaaaaataacaatttggtgtcaatgatctggtgacaataggattacattggagccaattgaataaatttattctttcaatcatatggatcttcattaatatttttgactgaattatcaattaaaaatatttcattccctttgtgcagaaactgctaaatccagggttcgattcttgaatgaactggcaagctggctgtggtctgtagatatacatcccacattttgttgttataacagttagtagttagtattgctttcatatatagactccagaatctaaattttacgataatgacatttcttctggtcatgacaaatgtaatattttacaaatataaatctacgtagaatccaaagacacacacggagcagtcctgtctgagaaataaaaaatcaggacacccatggcatcgtagtagcccctcgcgtccagcaggtggcgaagggaggtgaggtttatttattaaatgggaccgagtgggacggggacggggcagccctaagggtagggaagcattgtcaatttctggggatagaatgagacccaggcatagctggagtttgaagctttgaagcaaaaatatctgtagaacatcttaaacgtgaccaaaatatgatgttaaaatcagcaactctttatacgttaaaaactttgaaacctgtggccgggcatggtggctcgcgcctgtaatcccagcactttgggaggccaaggcaggtggatcacctgaggtcaggagctcaagaccagcctgaccaacatggtgaaaccccgtctctactaaaaatacaaaaattagctgggcatggtggcgcatgcctataatcccagctactcggaggctgaggcaggataatcgcttgaaaccgggagacagaggttgtggtgagccgagatcacgccattgcactccagccggggcaacaagagcaaaacttcatctcaaaaaaaaaaaataaaaaaaaagaaaaaggaaaaaaacaaacaaacaacaactttgaaacctaggaacaattttggacctgttggagcagaaatgtgtagttgtcattgaaggtgtgaacataccctacctctactctacatgtggaagacctgacccacagaggacatgaacccatgaagaagagtgatgtgacatgttttgcattttattagtaccatgatctaaccaactgagctaactggccacaccattttatcctttataatgatcactatgagggctgagtgcagaatggagtgtatgtggtcaagagtggaagctgtgaggctattgcagtaatccagaaagaaaggtgacaatggcttagacttcagtggtagtgttggaaatggacataaatagacatattcaggaaatatattgatcttagatctaataagacacgtaatagattagaagtagggaaattaatgaaaaagcagaattaaggatgacttctcactggcttgaaatgctaaaaaaagaaaaaatagggccgggcgcggtggctcacgcctgtaatcccagcactttcggaggccgagggaggtggatcacaaggtcaagagatagagaccatcctcgttgtgtagaaattgaa

SEQ ID NO: 301158 - DNA, 4442 bp, Homo sapiens
ttaatattgttgccctaggtttcttttgtttaatatttgtctggattgcctgttcccataaattgacctttaatcagttagctttgttcttaagattggtttaaaacgtagaataatagggaggagcatgggagggtgggacgtctaatgtaaatccagcccagtgattacattagctgggcgctgattaggttaggatgttgcccaggtacaaggccaggatcttcgggacctggcttcatttggagttcagctaccaaaaggaaaccttcctctgggtcctggagtatttggcctgaaattgggaactcggaagttgctgctccagggcgctccctgcggagctccgccgcccgcctctccgcccggcctttcccggcgtccccacgcggggcgcaaccgcgagaaagaaacgcaggtcgcaccgtcagcgcccagagcagcgccagtttccgggcccgggctgctctcggagccatgagctgcggccgcccccctcccgacgtggacggcatgatcaccctcaaggtggacaacctgacctaccgcacctctcccgacagcttgaggcgcgtgttcgagaagtacgggcgcgtgggcgacgtgtacatcccgcgggagccccacaccaaggcgccccggggcttcgctttcgtccgctttcacgaccggcgcgacgcccaagacgccgaggccgccatggacggggcggagctggacggacgcgagctgcgggtgcaggtggcgcgctatggccgccgggacctgccccgcagccgccagggagagccacgcggcaggtccagaggcggcggctacggacggcggagccgcagctacgggcggcggagccgcagccccaggcggcgacaccgcagccgatcccggggtcccagctgctccaggtcccgcagccgatctcgctataggggttctcgctatagccggtctccctacagccgatctccttacagccggtcgcgctacagccgctctccctacagcagatctcgctacagggaatctcgctacggcggatctcactacagctcatctggttacagtaactctcgctacagccgatatcacagcagccggtctcactcgaagtctgggtcctccactagctctcgctctgcatcaacctccaaatcgagctctgcgcgacgatccaagtcctcctcggtctccaggtctcgctcgcggtccaggtcttcatctatgaccaggagtcctccccgggtatccaagaggaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctggaagaagaggctgcctattgaaagtggcaaaattcattctatgtgccgttttgttgttattcacattttattgtaacttaggaggtgaacgacctaagattacgttattgggtttggatatttgaggcaaaaatttatttttatttctatagtgatgactgttttggtttgaaatgaacagattggtaacctaatttgtggcctcctgacttttaaggaaacgtgtgcagccattacacacagcctaacgctgtcaagacattgcttcaacattgccttcattccttaaaaacctacaaaaggtggtgtaaattaatatggataattttatttacctccaggtctaaaaggtagtgtgacccaaatttgtataaagatttttcatgtgaaaggactggggttttagcaaacacaggtctaatctcttttgtgtttttgtgcaccaggcccggctgcgtagcagttgagtgatgctggttagctattaaggtggcctgttgcagtgcagagtgctgagctgcttcctgttttcttctgattgctcctggggaaaacacgccttgtcctgaagaacaaatggctgtccagtttattaaaatgcctgtcaactgcacttccagtcacccaggccttgcagataaataatggagcatgcagtgagcacatctagctgacgataatcacaccttttcccccgtcttttctgaaaaattgtaaatctgatcatatcaacatgtatgaacttaaaatatggagaatgttatggaagaaatagtttataagtttgttaagtacttataacatggtttatctttttgattattaattttttacgctaaccattgtttctgtagttaaaattgttttcttggtgttatcttttctcagaataaaattagaaacttttgatggaaagtaggttgttttattttctgtatgacttttggatatttgtacttttgagaaaattattagcaccaagtgtttctcaaaatataatttttaaaaaatccttaataggcttttagctatgtgctttattgttttatcacaatgcagtttatttgtagtttctctcttttttcctcacacctatggtttttttacttccaaaattattttcaaataatccatttttggctttcatcattatccctactagatgttatgtgttcttttgcaattgtttctgcttatacctttactagcaaagggaaaaataacaatttggtgtcaatgatctggtgacaataggattacattggagccaattgaataaatttattctttcaatcatatggatcttcattaatatttttgactgaattatcaattaaaaatatttcattccctttgtgcagaaactgctaaatccagggttcgattcttgaatgaactggcaagctggctgtggtctgtagatatacatcccacattttgttgttataacagttagtagttagtattgctttcatatatagactccagaatctaaattttacgataatgacatttcttctggtcatgacaaatgtaatattttacaaatataaatctacgtagaatccaaagacacacacggagcagtcctgtctgagaaataaaaaatcaggacacccatggcatcgtagtagcccctcgcgtccagcaggtggcgaagggaggtgaggtttatttattaaatgggaccgagtgggacggggacggggcagccctaagggtagggaagcattgtcaatttctggggatagaatgagacccaggcatagctggagtttgaagctttgaagcaaaaatatctgtagaacatcttaaacgtgaccaaaatatgatgttaaaatcagcaactctttatacgttaaaaactttgaaacctgtggccgggcatggtggctcgcgcctgtaatcccagcactttgggaggccaaggcaggtggatcacctgaggtcaggagctcaagaccagcctgaccaacatggtgaaaccccgtctctactaaaaatacaaaaattagctgggcatggtggcgcatgcctataatcccagctactcggaggctgaggcaggataatcgcttgaaaccgggagacagaggttgtggtgagccgagatcacgccattgcactccagccggggcaacaagagcaaaacttcatctcaaaaaaaaaaaataaaaaaaaagaaaaaggaaaaaaacaaacaaacaacaactttgaaacctaggaacaattttggacctgttggagcagaaatgtgtagttgtcattgaaggtgtgaacataccctacctctactctacatgtggaagacctgacccacagaggacatgaacccatgaagaagagtgatgtgacatgttttgcattttattagtaccatgatctaaccaactgagctaactggccacaccattttatcctttataatgatcactatgagggctgagtgcagaatggagtgtatgtggtcaagagtggaagctgtgaggctattgcagtaatccagaaagaaaggtgacaatggcttagacttcagtggtagtgttggaaatggacataaatagacatattcaggaaatatattgatcttagatctaataagacacgtaatagattagaagtagggaaattaatgaaaaagcagaattaaggatgacttctcactggcttgaaatgctaaatggatgacggtgctgtttagtgagttggggaagactgggcgtggtgatgggtgtagaaattgagaaaggaaaatcaagaatttccagaactttcagagcaatgttaaatactttccttgatagtgggtcagtcatcatttataagtgcatttctaaaaatattgcttaattttgtttttgagctttgtataagtggaattttgtgtgtactgattattttgctcaatactatgtctttaagattctctgtattgttgcatgtggctgagtttatttttgatgctgtgtagtgttttactaattaataaatcataattcagtttttactgttctattgatggaaaaaagggtt

SEQ ID NO: 301159 - DNA, 4012 bp, Homo sapiens
ttaatattgttgccctaggtttcttttgtttaatatttgtctggattgcctgttcccataaattgacctttaatcagttagctttgttcttaagattggtttaaaacgtagaataatagggaggagcatgggagggtgggacgtctaatgtaaatccagcccagtgattacattagctgggcgctgattaggttaggatgttgcccaggtacaaggccaggatcttcgggacctggcttcatttggagttcagctaccaaaaggaaaccttcctctgggtcctggagtatttggcctgaaattgggaactcggaagttgctgctccagggcgctccctgcggagctccgccgcccgcctctccgcccggcctttcccggcgtccccacgcggggcgcaaccgcgagaaagaaacgcaggtcgcaccgtcagcgcccagagcagcgccagtttccgggcccgggctgctctcggagccatgagctgcggccgcccccctcccgacgtggacggcatgatcaccctcaaggtggacaacctgacctaccgcacctctcccgacagcttgaggcgcgtgttcgagaagtacgggcgcgtgggcgacgtgtacatcccgcgggagccccacaccaaggcgccccggggcttcgctttcgtccgctttcacgaccggcgcgacgcccaagacgccgaggccgccatggacggggcggagctggacggacgcgagctgcgggtgcaggtggcgcgctatggccgccgggacctgccccgcagccgccagggagagccacgcggcaggtccagaggcggcggctacggacggcggagccgcagctacgggcggcggagccgcagccccaggcggcgacaccgcagccgatcccggggtcccagctgctccaggtcccgcagccgatctcgctataggggttctcgctatagccggtctccctacagccgatctccttacagccggtcgcgctacagccgctctccctacagcagatctcgctacagggaatctcgctacggcggatctcactacagctcatctggttacagtaactctcgctacagccgatatcacagcagccggtctcactcgaagtctgggtcctccactagctctcgctctgcatcaacctccaaatcgagctctgcgcgacgatccaagtcctcctcggtctccaggtctcgctcgcggtccaggtcttcatctatgaccaggagtcctccccgggtatccaagaggaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctggaagaagaggctgcctattgaaatgcgtagcagttgagtgatgctggttagctattaaggtggcctgttgcagtgcagagtgctgagctgcttcctgttttcttctgattgctcctggggaaaacacgccttgtcctgaagaacaaatggctgtccagtttattaaaatgcctgtcaactgcacttccagtcacccaggccttgcagataaataatggagcatgcagtgagcacatctagctgacgataatcacaccttttcccccgtcttttctgaaaaattgtaaatctgatcatatcaacatgtatgaacttaaaatatggagaatgttatggaagaaatagtttataagtttgttaagtacttataacatggtttatctttttgattattaattttttacgctaaccattgtttctgtagttaaaattgttttcttggtgttatcttttctcagaataaaattagaaacttttgatggaaagtaggttgttttattttctgtatgacttttggatatttgtacttttgagaaaattattagcaccaagtgtttctcaaaatataatttttaaaaaatccttaataggcttttagctatgtgctttattgttttatcacaatgcagtttatttgtagtttctctcttttttcctcacacctatggtttttttacttccaaaattattttcaaataatccatttttggctttcatcattatccctactagatgttatgtgttcttttgcaattgtttctgcttatacctttactagcaaagggaaaaataacaatttggtgtcaatgatctggtgacaataggattacattggagccaattgaataaatttattctttcaatcatatggatcttcattaatatttttgactgaattatcaattaaaaatatttcattccctttgtgcagaaactgctaaatccagggttcgattcttgaatgaactggcaagctggctgtggtctgtagatatacatcccacattttgttgttataacagttagtagttagtattgctttcatatatagactccagaatctaaattttacgataatgacatttcttctggtcatgacaaatgtaatattttacaaatataaatctacgtagaatccaaagacacacacggagcagtcctgtctgagaaataaaaaatcaggacacccatggcatcgtagtagcccctcgcgtccagcaggtggcgaagggaggtgaggtttatttattaaatgggaccgagtgggacggggacggggcagccctaagggtagggaagcattgtcaatttctggggatagaatgagacccaggcatagctggagtttgaagctttgaagcaaaaatatctgtagaacatcttaaacgtgaccaaaatatgatgttaaaatcagcaactctttatacgttaaaaactttgaaacctgtggccgggcatggtggctcgcgcctgtaatcccagcactttgggaggccaaggcaggtggatcacctgaggtcaggagctcaagaccagcctgaccaacatggtgaaaccccgtctctactaaaaatacaaaaattagctgggcatggtggcgcatgcctataatcccagctactcggaggctgaggcaggataatcgcttgaaaccgggagacagaggttgtggtgagccgagatcacgccattgcactccagccggggcaacaagagcaaaacttcatctcaaaaaaaaaaaataaaaaaaaagaaaaaggaaaaaaacaaacaaacaacaactttgaaacctaggaacaattttggacctgttggagcagaaatgtgtagttgtcattgaaggtgtgaacataccctacctctactctacatgtggaagacctgacccacagaggacatgaacccatgaagaagagtgatgtgacatgttttgcattttattagtaccatgatctaaccaactgagctaactggccacaccattttatcctttataatgatcactatgagggctgagtgcagaatggagtgtatgtggtcaagagtggaagctgtgaggctattgcagtaatccagaaagaaaggtgacaatggcttagacttcagtggtagtgttggaaatggacataaatagacatattcaggaaatatattgatcttagatctaataagacacgtaatagattagaagtagggaaattaatgaaaaagcagaattaaggatgacttctcactggcttgaaatgctaaatggatgacggtgctgtttagtgagttggggaagactgggcgtggtgatgggtgtagaaattgagaaaggaaaatcaagaatttccagaactttcagagcaatgttaaatactttccttgatagtgggtcagtcatcatttataagtgcatttctaaaaatattgcttaattttgtttttgagctttgtataagtggaattttgtgtgtactgattattttgctcaatactatgtctttaagattctctgtattgttgcatgtggctgagtttatttttgatgctgtgtagtgttttactaattaataaatcataattcagtttttactgttctattgatggaaaaaagggtt

SEQ ID NO: 301160 - DNA, 3945 bp, Homo sapiens
ttaatattgttgccctaggtttcttttgtttaatatttgtctggattgcctgttcccataaattgacctttaatcagttagctttgttcttaagattggtttaaaacgtagaataatagggaggagcatgggagggtgggacgtctaatgtaaatccagcccagtgattacattagctgggcgctgattaggttaggatgttgcccaggtacaaggccaggatcttcgggacctggcttcatttggagttcagctaccaaaaggaaaccttcctctgggtcctggagtatttggcctgaaattgggaactcggaagttgctgctccagggcgctccctgcggagctccgccgcccgcctctccgcccggcctttcccggcgtccccacgcggggcgcaaccgcgagaaagaaacgcaggtcgcaccgtcagcgcccagagcagcgccagtttccgggcccgggctgctctcggagccatgagctgcggccgcccccctcccgacgtggacggcatgatcaccctcaaggtggacaacctgacctaccgcacctctcccgacagcttgaggcgcgtgttcgagaagtacgggcgcgtgggcgacgtgtacatcccgcgggagccccacaccaaggcgccccggggcttcgctttcgtccgctttcacgaccggcgcgacgcccaagacgccgaggccgccatggacggggcggagctggacggacgcgagctgcgggtgcaggtggcgcgctatggccgccgggacctgccccgcagccgccagggagagccacgcggcaggtccagaggcggcggctacggacggcggagccgcagctacgggcggcggagccgcagccccaggcggcgacaccgcagccgatcccggggtcccagctgctccaggtcccgcagccgatctcgctataggggttctcgctatagccggtctccctacagccgatctccttacagccggtcgcgctacagccgctctccctacagcagatctcgctacagggaatctcgctacggcggatctcactacagctcatctggttacagtaactctcgctacagccgatatcacagcagccggtctcactcgaagtctgggtcctccactagctctcgctctgcatcaacctccaaatcgagctctgcgcgacgatccaagtcctcctcggtctccaggtctcgctcgcggtccaggtcttcatctatgaccaggagtcctccccgggtatccaagaggaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctgttgcagtgcagagtgctgagctgcttcctgttttcttctgattgctcctggggaaaacacgccttgtcctgaagaacaaatggctgtccagtttattaaaatgcctgtcaactgcacttccagtcacccaggccttgcagataaataatggagcatgcagtgagcacatctagctgacgataatcacaccttttcccccgtcttttctgaaaaattgtaaatctgatcatatcaacatgtatgaacttaaaatatggagaatgttatggaagaaatagtttataagtttgttaagtacttataacatggtttatctttttgattattaattttttacgctaaccattgtttctgtagttaaaattgttttcttggtgttatcttttctcagaataaaattagaaacttttgatggaaagtaggttgttttattttctgtatgacttttggatatttgtacttttgagaaaattattagcaccaagtgtttctcaaaatataatttttaaaaaatccttaataggcttttagctatgtgctttattgttttatcacaatgcagtttatttgtagtttctctcttttttcctcacacctatggtttttttacttccaaaattattttcaaataatccatttttggctttcatcattatccctactagatgttatgtgttcttttgcaattgtttctgcttatacctttactagcaaagggaaaaataacaatttggtgtcaatgatctggtgacaataggattacattggagccaattgaataaatttattctttcaatcatatggatcttcattaatatttttgactgaattatcaattaaaaatatttcattccctttgtgcagaaactgctaaatccagggttcgattcttgaatgaactggcaagctggctgtggtctgtagatatacatcccacattttgttgttataacagttagtagttagtattgctttcatatatagactccagaatctaaattttacgataatgacatttcttctggtcatgacaaatgtaatattttacaaatataaatctacgtagaatccaaagacacacacggagcagtcctgtctgagaaataaaaaatcaggacacccatggcatcgtagtagcccctcgcgtccagcaggtggcgaagggaggtgaggtttatttattaaatgggaccgagtgggacggggacggggcagccctaagggtagggaagcattgtcaatttctggggatagaatgagacccaggcatagctggagtttgaagctttgaagcaaaaatatctgtagaacatcttaaacgtgaccaaaatatgatgttaaaatcagcaactctttatacgttaaaaactttgaaacctgtggccgggcatggtggctcgcgcctgtaatcccagcactttgggaggccaaggcaggtggatcacctgaggtcaggagctcaagaccagcctgaccaacatggtgaaaccccgtctctactaaaaatacaaaaattagctgggcatggtggcgcatgcctataatcccagctactcggaggctgaggcaggataatcgcttgaaaccgggagacagaggttgtggtgagccgagatcacgccattgcactccagccggggcaacaagagcaaaacttcatctcaaaaaaaaaaaataaaaaaaaagaaaaaggaaaaaaacaaacaaacaacaactttgaaacctaggaacaattttggacctgttggagcagaaatgtgtagttgtcattgaaggtgtgaacataccctacctctactctacatgtggaagacctgacccacagaggacatgaacccatgaagaagagtgatgtgacatgttttgcattttattagtaccatgatctaaccaactgagctaactggccacaccattttatcctttataatgatcactatgagggctgagtgcagaatggagtgtatgtggtcaagagtggaagctgtgaggctattgcagtaatccagaaagaaaggtgacaatggcttagacttcagtggtagtgttggaaatggacataaatagacatattcaggaaatatattgatcttagatctaataagacacgtaatagattagaagtagggaaattaatgaaaaagcagaattaaggatgacttctcactggcttgaaatgctaaatggatgacggtgctgtttagtgagttggggaagactgggcgtggtgatgggtgtagaaattgagaaaggaaaatcaagaatttccagaactttcagagcaatgttaaatactttccttgatagtgggtcagtcatcatttataagtgcatttctaaaaatattgcttaattttgtttttgagctttgtataagtggaattttgtgtgtactgattattttgctcaatactatgtctttaagattctctgtattgttgcatgtggctgagtttatttttgatgctgtgtagtgttttactaattaataaatcataattcagtttttactgttctattgatggaaaaaagggtt

SEQ ID NO: 301161 - DNA, 4476 bp, Homo sapiens
ttaatattgttgccctaggtttcttttgtttaatatttgtctggattgcctgttcccataaattgacctttaatcagttagctttgttcttaagattggtttaaaacgtagaataatagggaggagcatgggagggtgggacgtctaatgtaaatccagcccagtgattacattagctgggcgctgattaggttaggatgttgcccaggtacaaggccaggatcttcgggacctggcttcatttggagttcagctaccaaaaggaaaccttcctctgggtcctggagtatttggcctgaaattgggaactcggaagttgctgctccagggcgctccctgcggagctccgccgcccgcctctccgcccggcctttcccggcgtccccacgcggggcgcaaccgcgagaaagaaacgcaggtcgcaccgtcagcgcccagagcagcgccagtttccgggcccgggctgctctcggagccatgagctgcggccgcccccctcccgacgtggacggcatgatcaccctcaaggtggacaacctgacctaccgcacctctcccgacagcttgaggcgcgtgttcgagaagtacgggcgcgtgggcgacgtgtacatcccgcgggagccccacaccaaggcgccccggggcttcgctttcgtccgctttcacgaccggcgcgacgcccaagacgccgaggccgccatggacggggcggagctggacggacgcgagctgcgggtgcaggtggcgcgctatggccgccgggacctgccccgcagccgccagggagagccacgcggcaggtccagaggcggcggctacggacggcggagccgcagctacccccaggcggcgacaccgcagccgatcccggggtcccagctgctccaggtcccgcagccgatctcgctataggggttctcgctatagccggtctccctacagccgatctccttacagccggtcgcgctacagccgctctccctacagcagatctcgctacagggaatctcgctacggcggatctcactacagctcatctggttacagtaactctcgctacagccgatatcacagcagccggtctcactcgaagtctgggtcctccactagctctcgctctgcatcaacctccaaatcgagctctgcgcgacgatccaagtcctcctcggtctccaggtctcgctcgcggtccaggtcttcatctatgaccaggagtcctccccgggtatccaagaggaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctggaagaagaggctgcctattgaaaaggttgtgtcacacttttctacctttttgccagtttgaagctttgcatcaggtggcaaaattcattctatgtgccgttttgttgttattcacattttattgtaacttaggaggtgaacgacctaagattacgttattgggtttggatatttgaggcaaaaatttatttttatttctatagtgatgactgttttggtttgaaatgaacagattggtaacctaatttgtggcctcctgacttttaaggaaacgtgtgcagccattacacacagcctaacgctgtcaagacattgcttcaacattgccttcattccttaaaaacctacaaaaggtggtgtaaattaatatggataattttatttacctccaggtctaaaaggtagtgtgacccaaatttgtataaagatttttcatgtgaaaggactggggttttagcaaacacaggtctaatctcttttgtgtttttgtgcaccaggcccggctgcgtagcagttgagtgatgctggttagctattaaggtggcctgttgcagtgcagagtgctgagctgcttcctgttttcttctgattgctcctggggaaaacacgccttgtcctgaagaacaaatggctgtccagtttattaaaatgcctgtcaactgcacttccagtcacccaggccttgcagataaataatggagcatgcagtgagcacatctagctgacgataatcacaccttttcccccgtcttttctgaaaaattgtaaatctgatcatatcaacatgtatgaacttaaaatatggagaatgttatggaagaaatagtttataagtttgttaagtacttataacatggtttatctttttgattattaattttttacgctaaccattgtttctgtagttaaaattgttttcttggtgttatcttttctcagaataaaattagaaacttttgatggaaagtaggttgttttattttctgtatgacttttggatatttgtacttttgagaaaattattagcaccaagtgtttctcaaaatataatttttaaaaaatccttaataggcttttagctatgtgctttattgttttatcacaatgcagtttatttgtagtttctctcttttttcctcacacctatggtttttttacttccaaaattattttcaaataatccatttttggctttcatcattatccctactagatgttatgtgttcttttgcaattgtttctgcttatacctttactagcaaagggaaaaataacaatttggtgtcaatgatctggtgacaataggattacattggagccaattgaataaatttattctttcaatcatatggatcttcattaatatttttgactgaattatcaattaaaaatatttcattccctttgtgcagaaactgctaaatccagggttcgattcttgaatgaactggcaagctggctgtggtctgtagatatacatcccacattttgttgttataacagttagtagttagtattgctttcatatatagactccagaatctaaattttacgataatgacatttcttctggtcatgacaaatgtaatattttacaaatataaatctacgtagaatccaaagacacacacggagcagtcctgtctgagaaataaaaaatcaggacacccatggcatcgtagtagcccctcgcgtccagcaggtggcgaagggaggtgaggtttatttattaaatgggaccgagtgggacggggacggggcagccctaagggtagggaagcattgtcaatttctggggatagaatgagacccaggcatagctggagtttgaagctttgaagcaaaaatatctgtagaacatcttaaacgtgaccaaaatatgatgttaaaatcagcaactctttatacgttaaaaactttgaaacctgtggccgggcatggtggctcgcgcctgtaatcccagcactttgggaggccaaggcaggtggatcacctgaggtcaggagctcaagaccagcctgaccaacatggtgaaaccccgtctctactaaaaatacaaaaattagctgggcatggtggcgcatgcctataatcccagctactcggaggctgaggcaggataatcgcttgaaaccgggagacagaggttgtggtgagccgagatcacgccattgcactccagccggggcaacaagagcaaaacttcatctcaaaaaaaaaaaataaaaaaaaagaaaaaggaaaaaaacaaacaaacaacaactttgaaacctaggaacaattttggacctgttggagcagaaatgtgtagttgtcattgaaggtgtgaacataccctacctctactctacatgtggaagacctgacccacagaggacatgaacccatgaagaagagtgatgtgacatgttttgcattttattagtaccatgatctaaccaactgagctaactggccacaccattttatcctttataatgatcactatgagggctgagtgcagaatggagtgtatgtggtcaagagtggaagctgtgaggctattgcagtaatccagaaagaaaggtgacaatggcttagacttcagtggtagtgttggaaatggacataaatagacatattcaggaaatatattgatcttagatctaataagacacgtaatagattagaagtagggaaattaatgaaaaagcagaattaaggatgacttctcactggcttgaaatgctaaatggatgacggtgctgtttagtgagttggggaagactgggcgtggtgatgggtgtagaaattgagaaaggaaaatcaagaatttccagaactttcagagcaatgttaaatactttccttgatagtgggtcagtcatcatttataagtgcatttctaaaaatattgcttaattttgtttttgagctttgtataagtggaattttgtgtgtactgattattttgctcaatactatgtctttaagattctctgtattgttgcatgtggctgagtttatttttgatgctgtgtagtgttttactaattaataaatcataattcagtttttactgttctattgatggaaaaaagggtt

SEQ ID NO: 301162 - DNA, 3924 bp, Homo sapiens
ttaatattgttgccctaggtttcttttgtttaatatttgtctggattgcctgttcccataaattgacctttaatcagttagctttgttcttaagattggtttaaaacgtagaataatagggaggagcatgggagggtgggacgtctaatgtaaatccagcccagtgattacattagctgggcgctgattaggttaggatgttgcccaggtacaaggccaggatcttcgggacctggcttcatttggagttcagctaccaaaaggaaaccttcctctgggtcctggagtatttggcctgaaattgggaactcggaagttgctgctccagggcgctccctgcggagctccgccgcccgcctctccgcccggcctttcccggcgtccccacgcggggcgcaaccgcgagaaagaaacgcaggtcgcaccgtcagcgcccagagcagcgccagtttccgggcccgggctgctctcggagccatgagctgcggccgcccccctcccgacgtggacggcatgatcaccctcaaggtggacaacctgacctaccgcacctctcccgacagcttgaggcgcgtgttcgagaagtacgggcgcgtgggcgacgtgtacatcccgcgggagccccacaccaaggcgccccggggcttcgctttcgtccgctttcacgaccggcgcgacgcccaagacgccgaggccgccatggacggggcggagctggacggacgcgagctgcgggtgcaggtggcgcgctatggccgccgggacctgccccgcagccgccagggagagccacgcggcaggtccagaggcggcggctacggacggcggagccgcagctacgggcggcggagccgcagccccaggcggcgacaccgcagccgatcccggggtcccagctgctccaggtcccgcagccgatctcgctataggggttctcgctatagccggtctccctacagccgatctccttacagccggtcgcgctacagccgctctccctacagcagatctcgctacagggaatctcgctacggcggatctcactacagctcatctggttacagtaactctcgctacagccgatatcacagcagccggtctcactcgaagtctgggtcctccactagctctcgctctgcatcaacctccaaatcgagctctgcgcgaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctggaagaagaggctgcctattgaaatgcgtagcagttgagtgatgctggttagctattaaggtggcctgttgcagtgcagagtgctgagctgcttcctgttttcttctgattgctcctggggaaaacacgccttgtcctgaagaacaaatggctgtccagtttattaaaatgcctgtcaactgcacttccagtcacccaggccttgcagataaataatggagcatgcagtgagcacatctagctgacgataatcacaccttttcccccgtcttttctgaaaaattgtaaatctgatcatatcaacatgtatgaacttaaaatatggagaatgttatggaagaaatagtttataagtttgttaagtacttataacatggtttatctttttgattattaattttttacgctaaccattgtttctgtagttaaaattgttttcttggtgttatcttttctcagaataaaattagaaacttttgatggaaagtaggttgttttattttctgtatgacttttggatatttgtacttttgagaaaattattagcaccaagtgtttctcaaaatataatttttaaaaaatccttaataggcttttagctatgtgctttattgttttatcacaatgcagtttatttgtagtttctctcttttttcctcacacctatggtttttttacttccaaaattattttcaaataatccatttttggctttcatcattatccctactagatgttatgtgttcttttgcaattgtttctgcttatacctttactagcaaagggaaaaataacaatttggtgtcaatgatctggtgacaataggattacattggagccaattgaataaatttattctttcaatcatatggatcttcattaatatttttgactgaattatcaattaaaaatatttcattccctttgtgcagaaactgctaaatccagggttcgattcttgaatgaactggcaagctggctgtggtctgtagatatacatcccacattttgttgttataacagttagtagttagtattgctttcatatatagactccagaatctaaattttacgataatgacatttcttctggtcatgacaaatgtaatattttacaaatataaatctacgtagaatccaaagacacacacggagcagtcctgtctgagaaataaaaaatcaggacacccatggcatcgtagtagcccctcgcgtccagcaggtggcgaagggaggtgaggtttatttattaaatgggaccgagtgggacggggacggggcagccctaagggtagggaagcattgtcaatttctggggatagaatgagacccaggcatagctggagtttgaagctttgaagcaaaaatatctgtagaacatcttaaacgtgaccaaaatatgatgttaaaatcagcaactctttatacgttaaaaactttgaaacctgtggccgggcatggtggctcgcgcctgtaatcccagcactttgggaggccaaggcaggtggatcacctgaggtcaggagctcaagaccagcctgaccaacatggtgaaaccccgtctctactaaaaatacaaaaattagctgggcatggtggcgcatgcctataatcccagctactcggaggctgaggcaggataatcgcttgaaaccgggagacagaggttgtggtgagccgagatcacgccattgcactccagccggggcaacaagagcaaaacttcatctcaaaaaaaaaaaataaaaaaaaagaaaaaggaaaaaaacaaacaaacaacaactttgaaacctaggaacaattttggacctgttggagcagaaatgtgtagttgtcattgaaggtgtgaacataccctacctctactctacatgtggaagacctgacccacagaggacatgaacccatgaagaagagtgatgtgacatgttttgcattttattagtaccatgatctaaccaactgagctaactggccacaccattttatcctttataatgatcactatgagggctgagtgcagaatggagtgtatgtggtcaagagtggaagctgtgaggctattgcagtaatccagaaagaaaggtgacaatggcttagacttcagtggtagtgttggaaatggacataaatagacatattcaggaaatatattgatcttagatctaataagacacgtaatagattagaagtagggaaattaatgaaaaagcagaattaaggatgacttctcactggcttgaaatgctaaatggatgacggtgctgtttagtgagttggggaagactgggcgtggtgatgggtgtagaaattgagaaaggaaaatcaagaatttccagaactttcagagcaatgttaaatactttccttgatagtgggtcagtcatcatttataagtgcatttctaaaaatattgcttaattttgtttttgagctttgtataagtggaattttgtgtgtactgattattttgctcaatactatgtctttaagattctctgtattgttgcatgtggctgagtttatttttgatgctgtgtagtgttttactaattaataaatcataattcagtttttactgttctattgatggaaaaaagggtt

SEQ ID NO: 301163 - DNA, 4137 bp, Homo sapiens
ttaatattgttgccctaggtttcttttgtttaatatttgtctggattgcctgttcccataaattgacctttaatcagttagctttgttcttaagattggtttaaaacgtagaataatagggaggagcatgggagggtgggacgtctaatgtaaatccagcccagtgattacattagctgggcgctgattaggttaggatgttgcccaggtacaaggccaggatcttcgggacctggcttcatttggagttcagctaccaaaaggaaaccttcctctgggtcctggagtatttggcctgaaattgggaactcggaagttgctgctccagggcgctccctgcggagctccgccgcccgcctctccgcccggcctttcccggcgtccccacgcggggcgcaaccgcgagaaagaaacgcaggtcgcaccgtcagcgcccagagcagcgccagtttccgggcccgggctgctctcggagccatgagctgggcggcggagccgcagccccaggcggcgacaccgcagccgatcccggggtcccagctgctccaggtcccgcagccgatctcgctataggggttctcgctatagccggtctccctacagccgatctccttacagccggtcgcgctacagccgctctccctacagcagatctcgctacagggaatctcgctacggcggatctcactacagctcatctggttacagtaactctcgctacagccgatatcacagcagccggtctcactcgaagtctgggtcctccactagctctcgctctgcatcaacctccaaatcgagctctgcgcgacgatccaagtcctcctcggtctccaggtctcgctcgcggtccaggtcttcatctatgaccaggagtcctccccgggtatccaagaggaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctggaagaagaggctgcctattgaaaaggttgtgtcacacttttctacctttttgccagtttgaagctttgcatcaggtggcaaaattcattctatgtgccgttttgttgttattcacattttattgtaacttaggaggtgaacgacctaagattacgttattgggtttggatatttgaggcaaaaatttatttttatttctatagtgatgactgttttggtttgaaatgaacagattggtaacctaatttgtggcctcctgacttttaaggaaacgtgtgcagccattacacacagcctaacgctgtcaagacattgcttcaacattgccttcattccttaaaaacctacaaaaggtggtgtaaattaatatggataattttatttacctccaggtctaaaaggtagtgtgacccaaatttgtataaagatttttcatgtgaaaggactggggttttagcaaacacaggtctaatctcttttgtgtttttgtgcaccaggcccggctgcgtagcagttgagtgatgctggttagctattaaggtggcctgttgcagtgcagagtgctgagctgcttcctgttttcttctgattgctcctggggaaaacacgccttgtcctgaagaacaaatggctgtccagtttattaaaatgcctgtcaactgcacttccagtcacccaggccttgcagataaataatggagcatgcagtgagcacatctagctgacgataatcacaccttttcccccgtcttttctgaaaaattgtaaatctgatcatatcaacatgtatgaacttaaaatatggagaatgttatggaagaaatagtttataagtttgttaagtacttataacatggtttatctttttgattattaattttttacgctaaccattgtttctgtagttaaaattgttttcttggtgttatcttttctcagaataaaattagaaacttttgatggaaagtaggttgttttattttctgtatgacttttggatatttgtacttttgagaaaattattagcaccaagtgtttctcaaaatataatttttaaaaaatccttaataggcttttagctatgtgctttattgttttatcacaatgcagtttatttgtagtttctctcttttttcctcacacctatggtttttttacttccaaaattattttcaaataatccatttttggctttcatcattatccctactagatgttatgtgttcttttgcaattgtttctgcttatacctttactagcaaagggaaaaataacaatttggtgtcaatgatctggtgacaataggattacattggagccaattgaataaatttattctttcaatcatatggatcttcattaatatttttgactgaattatcaattaaaaatatttcattccctttgtgcagaaactgctaaatccagggttcgattcttgaatgaactggcaagctggctgtggtctgtagatatacatcccacattttgttgttataacagttagtagttagtattgctttcatatatagactccagaatctaaattttacgataatgacatttcttctggtcatgacaaatgtaatattttacaaatataaatctacgtagaatccaaagacacacacggagcagtcctgtctgagaaataaaaaatcaggacacccatggcatcgtagtagcccctcgcgtccagcaggtggcgaagggaggtgaggtttatttattaaatgggaccgagtgggacggggacggggcagccctaagggtagggaagcattgtcaatttctggggatagaatgagacccaggcatagctggagtttgaagctttgaagcaaaaatatctgtagaacatcttaaacgtgaccaaaatatgatgttaaaatcagcaactctttatacgttaaaaactttgaaacctgtggccgggcatggtggctcgcgcctgtaatcccagcactttgggaggccaaggcaggtggatcacctgaggtcaggagctcaagaccagcctgaccaacatggtgaaaccccgtctctactaaaaatacaaaaattagctgggcatggtggcgcatgcctataatcccagctactcggaggctgaggcaggataatcgcttgaaaccgggagacagaggttgtggtgagccgagatcacgccattgcactccagccggggcaacaagagcaaaacttcatctcaaaaaaaaaaaataaaaaaaaagaaaaaggaaaaaaacaaacaaacaacaactttgaaacctaggaacaattttggacctgttggagcagaaatgtgtagttgtcattgaaggtgtgaacataccctacctctactctacatgtggaagacctgacccacagaggacatgaacccatgaagaagagtgatgtgacatgttttgcattttattagtaccatgatctaaccaactgagctaactggccacaccattttatcctttataatgatcactatgagggctgagtgcagaatggagtgtatgtggtcaagagtggaagctgtgaggctattgcagtaatccagaaagaaaggtgacaatggcttagacttcagtggtagtgttggaaatggacataaatagacatattcaggaaatatattgatcttagatctaataagacacgtaatagattagaagtagggaaattaatgaaaaagcagaattaaggatgacttctcactggcttgaaatgctaaatggatgacggtgctgtttagtgagttggggaagactgggcgtggtgatgggtgtagaaattgagaaaggaaaatcaagaatttccagaactttcagagcaatgttaaatactttccttgatagtgggtcagtcatcatttataagtgcatttctaaaaatattgcttaattttgtttttgagctttgtataagtggaattttgtgtgtactgattattttgctcaatactatgtctttaagattctctgtattgttgcatgtggctgagtttatttttgatgctgtgtagtgttttactaattaataaatcataattcagtttttactgttctattgatggaaaaaagggtt

SEQ ID NO: 301164 - DNA, 1891 bp, Homo sapiens
ttaatattgttgccctaggtttcttttgtttaatatttgtctggattgcctgttcccataaattgacctttaatcagttagctttgttcttaagattggtttaaaacgtagaataatagggaggagcatgggagggtgggacgtctaatgtaaatccagcccagtgattacattagctgggcgctgattaggttaggatgttgcccaggtacaaggccaggatcttcgggacctggcttcatttggagttcagctaccaaaaggaaaccttcctctgggtcctggagtatttggcctgaaattgggaactcggaagttgctgctccagggcgctccctgcggagctccgccgcccgcctctccgcccggcctttcccggcgtccccacgcggggcgcaaccgcgagaaagaaacgcaggtcgcaccgtcagcgcccagagcagcgccagtttccgggcccgggctgctctcggagccatgagctgcggccgcccccctcccgacgtggacggcatgatcaccctcaaggtggacaacctgacctaccgcacctctcccgacagcttgaggcgcgtgttcgagaagtacgggcgcgtgggcgacgtgtacatcccgcgggagccccacaccaaggcgccccggggcttcgctttcgtccgctttcacgaccggcgcgacgcccaagacgccgaggccgccatggacggggcggagctggacggacgcgagctgcgggtgcaggtggcgcgctatggccgccgggacctgccccgcagccgccagggagagccacgcggcaggtccagaggcggcggctacggacggcggagccgcagctacgggcggcggagccgcagccccaggcggcgacaccgcagccgatcccggggtcccagctgctccaggtcccgcagccgatctcgctataggggttctcgctatagccggtctccctacagccgatctccttacagccggtcgcgctacagccgctctccctacagcagatctcgctacagggaatctcgctacggcggatctcactacagctcatctggttacagtaactctcgctacagccgatatcacagcagccggtctcactcgaagtctgggtcctccactagctctcgctctgcatcaacctccaaatcgagctctgcgcgacgatccaagtcctcctcggtctccaggtctcgctcgcggtccaggtcttcatctatgaccaggagtcctccccgggtatccaagaggaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctggaagaagaggctgcctattgaaatgcgtagcagttgagtgatgctggttagctattaaggtggcctgttgcagtgcagagtgctgagctgcttcctgttttcttctgattgctcctggggaaaacacgccttgtcctgaagaacaaatggctgtccagtttattaaaatgcctgtcaactgcacttccagtcacccaggccttgcagataaataatggagcatgcagtgagcacatctagctgacgataatcacaccttttcccccgtcttttctgaaaaattgtaaatctgatcatatcaacatgtatgaacttaaaatatggagaatgttatggaagaaatagtttataagtttgttaagtacttataacatggtttatctttttgattattaattttttacgctaaccattgtttctgtagttaaaattgttttcttggtgttatcttttctcagaataaaattagaaacttttgatgg

SEQ ID NO: 301165 - DNA, 1598 bp, Homo sapiens
ttaatattgttgccctaggtttcttttgtttaatatttgtctggattgcctgttcccataaattgacctttaatcagttagctttgttcttaagattggtttaaaacgtagaataatagggaggagcatgggagggtgggacgtctaatgtaaatccagcccagtgattacattagctgggcgctgattaggttaggatgttgcccaggtacaaggccaggatcttcgggacctggcttcatttggagttcagctaccaaaaggaaaccttcctctgggtcctggagtatttggcctgaaattgggaactcggaagttgctgctccagggcgctccctgcggagctccgccgcccgcctctccgcccggcctttcccggcgtccccacgcggggcgcaaccgcgagaaagaaacgcaggtcgcaccgtcagcgcccagagcagcgccagtttccgggcccgggctgctctcggagccatgagctgcggccgcccccctcccgacgtggacggcatgatcaccctcaaggtggacaacctgacctaccgcacctctcccgacagcttgaggcgcgtgttcgagaagtacgggcgcgtgggcgacgtgtacatcccgcgggagccccacaccaaggcgccccggggcttcgctttcgtccgctttcacgaccggcgcgacgcccaagacgccgaggccgccatggacggggcggagctggacggacgcgagctgcgggtgcaggtggcgcgctatggccgccgggacctgccccgcagccgccagggagagccacgcggcaggtccagaggcggcggctacggacggcggagccgcagctacgggcggcggagccgcagccccaggcggcgacaccgcagccgatcccggggtcccagctgctccaggtcccgcagccgatctcgctataggggttctcgctatagccggtctccctacagccgatctccttacagccggtcgcgctacagccgctctccctacagcagatctcgctacagggaatctcgctacggcggatctcactacagctcatctggttacagtaactctcgctacagccgatatcacagcagccggtctcactcgaagtctgggtcctccactagctctcgctctgcatcaacctccaaatcgagctctgcgcgacgatccaagtcctcctcggtctccaggtctcgctcgcggtccaggtcttcatctatgaccaggagtcctccccgggtatccaagaggaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctggaagaagaggctgcctattgaaaaggttgtgtcacacttttctacctttttgccagtttgaagctttgcatcaggtggcaaaattcattctatgtgccgttttgttgttattcacattttattgtaacttaggaggtgaacgacctaagattacaataaaatgtgaattacaacaaaatgaaccatagt

SEQ ID NO: 301166 - DNA, 2652 bp, Homo sapiens
caatacacagatcatatagaaacaagtcatgagaacaagaggctgcctattgaaaaagccaggatagaataatgcgtagcagttgagtgatgctggttagctattaaggtggcctgttgcagtgcagagtgctgagctgcttcctgttttcttctgattgctcctggggaaaacacgccttgtcctgaagaacaaatggctgtccagtttattaaaatgcctgtcaactgcacttccagtcacccaggccttgcagataaataatggagcatgcagtgagcacatctagctgacgataatcacaccttttcccccgtcttttctgaaaaattgtaaatctgatcatatcaacatgtatgaacttaaaatatggagaatgttatggaagaaatagtttataagtttgttaagtacttataacatggtttatctttttgattattaattttttacgctaaccattgtttctgtagttaaaattgttttcttggtgttatcttttctcagaataaaattagaaacttttgatggaaagtaggttgttttattttctgtatgacttttggatatttgtacttttgagaaaattattagcaccaagtgtttctcaaaatataatttttaaaaaatccttaataggcttttagctatgtgctttattgttttatcacaatgcagtttatttgtagtttctctcttttttcctcacacctatggtttttttacttccaaaattattttcaaataatccatttttggctttcatcattatccctactagatgttatgtgttcttttgcaattgtttctgcttatacctttactagcaaagggaaaaataacaatttggtgtcaatgatctggtgacaataggattacattggagccaattgaataaatttattctttcaatcatatggatcttcattaatatttttgactgaattatcaattaaaaatatttcattccctttgtgcagaaactgctaaatccagggttcgattcttgaatgaactggcaagctggctgtggtctgtagatatacatcccacattttgttgttataacagttagtagttagtattgctttcatatatagactccagaatctaaattttacgataatgacatttcttctggtcatgacaaatgtaatattttacaaatataaatctacgtagaatccaaagacacacacggagcagtcctgtctgagaaataaaaaatcaggacacccatggcatcgtagtagcccctcgcgtccagcaggtggcgaagggaggtgaggtttatttattaaatgggaccgagtgggacggggacggggcagccctaagggtagggaagcattgtcaatttctggggatagaatgagacccaggcatagctggagtttgaagctttgaagcaaaaatatctgtagaacatcttaaacgtgaccaaaatatgatgttaaaatcagcaactctttatacgttaaaaactttgaaacctgtggccgggcatggtggctcgcgcctgtaatcccagcactttgggaggccaaggcaggtggatcacctgaggtcaggagctcaagaccagcctgaccaacatggtgaaaccccgtctctactaaaaatacaaaaattagctgggcatggtggcgcatgcctataatcccagctactcggaggctgaggcaggataatcgcttgaaaccgggagacagaggttgtggtgagccgagatcacgccattgcactccagccggggcaacaagagcaaaacttcatctcaaaaaaaaaaaataaaaaaaaagaaaaaggaaaaaaacaaacaaacaacaactttgaaacctaggaacaattttggacctgttggagcagaaatgtgtagttgtcattgaaggtgtgaacataccctacctctactctacatgtggaagacctgacccacagaggacatgaacccatgaagaagagtgatgtgacatgttttgcattttattagtaccatgatctaaccaactgagctaactggccacaccattttatcctttataatgatcactatgagggctgagtgcagaatggagtgtatgtggtcaagagtggaagctgtgaggctattgcagtaatccagaaagaaaggtgacaatggcttagacttcagtggtagtgttggaaatggacataaatagacatattcaggaaatatattgatcttagatctaataagacacgtaatagattagaagtagggaaattaatgaaaaagcagaattaaggatgacttctcactggcttgaaatgctaaatggatgacggtgctgtttagtgagttggggaagactgggcgtggtgatgggtgtagaaattgagaaaggaaaatcaagaatttccagaactttcagagcaatgttaaatactttccttgatagtgggtcagtcatcatttataagtgcatttctaaaaatattgcttaattttgtttttgagctttgtataagtggaattttgtgtgtactgattattttgctcaatactatgtctttaagattctctgtattgttgcatgtggctgagtttatttttgatgctgtgtagtgttttactaattaataaatcataattcagtttttactgttctattgatggaaaaaagggtt

SEQ ID NO: 301167 - DNA, 1027 bp, Homo sapiens
  misc_feature (1)..(1): n is a, c, g, or t
  misc_feature (4)..(4): n is a, c, g, or t
  misc_feature (6)..(6): n is a, c, g, or t
ngcncnggcggaggctcagtctgcgcgcaggaccggcccaagtccggggcccccgtgtccctcgcgtccctcctcccggcccgggcccctcgcccgtggccgccccggccccttttgcggagaggcagagactccgcgcgtcgccatttctggactaggctgttgctttctgtgctttttctgcgggcgcctctgcaaacggcggcgccggggaccgaccccccgcccgggctcggggcgctgctggcgtgtcccggggttccggcctcgaggtgtgcccgccagggctctggaggcgttcagttgcatttgggccgggggaccgggccggaggggctcggaggacatgagagcctggcttcggcggccttcgtcttccagagaggaggttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaatgacttttgtcatgacattttgttctacttatactgtaaattatgcattataaagagttcatttaaggaaaattacttggtacaataattattgtaattaagagatgtagcctttattaaaattttatatttttc

SEQ ID NO: 301168 - DNA, 3480 bp, Homo sapiens
  misc_feature (1)..(1): n is a, c, g, or t
  misc_feature (4)..(4): n is a, c, g, or t
  misc_feature (6)..(6): n is a, c, g, or t
ngcncnggcggaggctcagtctgcgcgcaggaccggcccaagtccggggcccccgtgtccctcgcgtccctcctcccggcccgggcccctcgcccgtggccgccccggccccttttgcggagaggcagagactccgcgcgtcgccatttctggactaggctgttgctttctgtgctttttctgcgggcgcctctgcaaacggcggcgccggggaccgaccccccgcccgggctcggggcgctgctggcgtgtcccggggttccggcctcgaggtgtgcccgccagggctctggaggcgttcagttgcatttgggccgggggaccgggccggaggggctcggaggacatgagagcctggcttcggcggccttcgtcttccagagaggaggttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcctgccaccaagacctacataagagatggcatcaagaagcagcagattgattccatcatgtttgaccaggcgcagaccgagatccagtcggtgatggaggaaaatgcctaccagatgtttttgacttctgatatatacctcgaatatgtgaggagtgggggagaaaacacagcttacatgagtaatgggggactcgggagcctaaaggtcgtgtgtggctatctccccaccttgaatgaagaagaggagtggacttgtgccgacttcaagtgcaaactttcgccaaccgtggttggcttgtccagcaaaactctgagggccacggcgagtgtgaggtccacggaaactgttgacagtggatacaggtccttcaagaggagcgatcctgttaatccttatcacataggttctggctatgtctttgcaccagccaccagcgccaacgacagtgagatatccagtgatgcgctgacggatgattccatgtccatgacggacagcagtgtagatggaattcctccttatcgtgtgggcagtaagaaacagctccagagagaaatgcatcgcagtgtgaaggccaatggccaagtgtctctacctcatttcccgagaacccaccgcctgcccaaggagatgacccccgtggaacccgccacctttgcagctgagctgatctcgaggctggaaaagctgaagctggagttggagagccgccacagcctggaggagcgcctgcagcagatccgagaggatgaagagagagagggctccgagctcacactcaattcgcgggagggggcgcccacgcagcaccccctctccctactgccctccggcagctacgaggaagacccgcagacgatactggacgatcacctgtccagggtcctcaagacccctggctgccagtctccgggcgtaggccgctatagccctcgctcccgctccccggaccaccaccaccaccaccattcgcagtaccactccctgctcccgcccggtggcaagctgcctcccgcggccgcctcgccgggcgcctgccccctcctcgggggcaaaggctttgtgaccaagcagacgacgaagcatgtccaccaccactacatccaccaccatgccgtccccaagaccaaggaggagatcgaggcggaggccacgcagcgggtgcactgcttctgccctgggggcagcgagtattactgctactcgaaatgcaaaagccactccaaggctccggaaaccatgcccagcgagcagtttggcggcagcagaggcagtaccttgcccaaacgcaatgggaaaggcacggagccgggcctggccctgcccgccagggaaggaggggcccccggcggagctggggccctgcagcttccccgggaggaaggagacaggtcgcaggatgtctggcagtggatgctggagagtgagcggcagagcaagcccaagccccatagtgcccaaagcacaaaaaaggcctaccccttggagtctgcccgctcgtctccaggcgaacgagccagccggcaccatctgtgggggggcaacagcgggcacccccgcaccaccccccgtgcccacctgttcacccaggaccctgcgatgcctcccctgaccccacccaacacgctggctcagctggaggaggcctgtcgcaggctagctgaggtgtcgaagcccccaaagcagcggtgctgtgtggccagtcagcagagggacaggaatcattcggccactgttcagacgggagccacacccttctccaatccaagcctggctccagaagatcacaaagagccaaagaaactggcaggtgtccacgcgctccaggccagtgagttggttgtcacttactttttctgtggggaagaaattccataccggaggatgctgaaggctcagagcttgaccctgggccactttaaagagcagctcagcaaaaagggaaattataggtattacttcaaaaaagcaagcgatgagtttgcctgtggagcggtgtttgaggagatctgggaggatgagacggtgctcccgatgtatgaaggccggattctgggcaaagtggagcggatcgattgagccctggggtctggctttggtgaactgttggagcccgaagctcttgtgaactgtcttggctgtgagcaactgcgacaaaacattttgaaggaaaattaaaccaatgaagaagacaaagtctaaggaagaatcggccagtgggcttcgggagggcggggggaggttgattttcatgattcatgagctgggtactgactgagataagaaaagcctgaactatttattaaaaacatgaccactcttggctattgaagatgctgcctgtatttgagagactgccatacataatatatgacttcctagggatctgaaatccataaactaagagaaactgtgtatagcttacctgaacaggaatccttactgatatttatagaacagttgatttcccccatccccagtttatggatatgctgctttaaacttgggaagggggagacaggtaagtttt

SEQ ID NO: 301169 - DNA, 3196 bp, Homo sapiens
cagcccgagagccgggaaataaaaataacccctcagagcgatggatttcggggccgcccggcggccgaggcgcccgccgaaggccctgctgtaaaagagaggaggttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcctgccaccaagacctacataagagatggcatcaagaagcagcagattgattccatcatgtttgaccaggcgcagaccgagatccagtcggtgatggaggaaaatgcctaccagatgtttttgacttctgatatatacctcgaatatgtgaggagtgggggagaaaacacagcttacatgagtaatgggggactcgggagcctaaaggtcgtgtgtggctatctccccaccttgaatgaagaagaggagtggacttgtgccgacttcaagtgcaaactttcgccaaccgtggttggcttgtccagcaaaactctgagggccacggcgagtgtgaggtccacggaaactgttgacagtggatacaggtccttcaagaggagcgatcctgttaatccttatcacataggttctggctatgtctttgcaccagccaccagcgccaacgacagtgagatatccagtgatgcgctgacggatgattccatgtccatgacggacagcagtgtagatggaattcctccttatcgtgtgggcagtaagaaacagctccagagagaaatgcatcgcagtgtgaaggccaatggccaagtgtctctacctcatttcccgagaacccaccgcctgcccaaggagatgacccccgtggaacccgccacctttgcagctgagctgatctcgaggctggaaaagctgaagctggagttggagagccgccacagcctggaggagcgcctgcagcagatccgagaggatgaagagagagagggctccgagctcacactcaattcgcgggagggggcgcccacgcagcaccccctctccctactgccctccggcagctacgaggaagacccgcagacgatactggacgatcacctgtccagggtcctcaagacccctggctgccagtctccgggcgtaggccgctatagccctcgctcccgctccccggaccaccaccaccaccaccattcgcagtaccactccctgctcccgcccggtggcaagctgcctcccgcggccgcctcgccgggcgcctgccccctcctcgggggcaaaggctttgtgaccaagcagacgacgaagcatgtccaccaccactacatccaccaccatgccgtccccaagaccaaggaggagatcgaggcggaggccacgcagcgggtgcactgcttctgccctgggggcagcgagtattactgctactcgaaatgcaaaagccactccaaggctccggaaaccatgcccagcgagcagtttggcggcagcagaggcagtaccttgcccaaacgcaatgggaaaggcacggagccgggcctggccctgcccgccagggaaggaggggcccccggcggagctggggccctgcagcttccccgggaggaaggagacaggtcgcaggatgtctggcagtggatgctggagagtgagcggcagagcaagcccaagccccatagtgcccaaagcacaaaaaaggcctaccccttggagtctgcccgctcgtctccaggcgaacgagccagccggcaccatctgtgggggggcaacagcgggcacccccgcaccaccccccgtgcccacctgttcacccaggaccctgcgatgcctcccctgaccccacccaacacgctggctcagctggaggaggcctgtcgcaggctagctgaggtgtcgaagcccccaaagcagcggtgctgtgtggccagtcagcagagggacaggaatcattcggccactgttcagacgggagccacacccttctccaatccaagcctggctccagaagatcacaaagagccaaagaaactggcaggtgtccacgcgctccaggccagtgagttggttgtcacttactttttctgtggggaagaaattccataccggaggatgctgaaggctcagagcttgaccctgggccactttaaagagcagctcagcaaaaagggaaattataggtattacttcaaaaaagcaagcgatgagtttgcctgtggagcggtgtttgaggagatctgggaggatgagacggtgctcccgatgtatgaaggccggattctgggcaaagtggagcggatcgattgagccctggggtctggctttggtgaactgttggagcccgaagctcttgtgaactgtcttggctgtgagcaactgcgacaaaacattttgaaggaaaattaaaccaatgaagaagacaaagtctaaggaagaatcggccagtgggcttcgggagggcggggggaggttgattttcatgattcatgagctgggtactgactgagataagaaaagcctgaactatttattaaaaacatgaccactcttggctattgaagatgctgcctgtatttgagagactgccatacataatatatgacttcctagggatctgaaatccataaactaagagaaactgtgtatagcttacctgaacaggaatccttactgatatttatagaacagttgatttcccccatccccagtttatggatatgctgctttaaacttgggaagggggagacaggtaagtttt

SEQ ID NO: 301170 - DNA, 3228 bp, Homo sapiens
gttccccgacgccgcggccggcccgggggggcccggggctgccgccgcgagccgagccgggggccggggccgggcccctgccaggggcgcctgcgaggtctcgccgccgagcgcgcgcggggatcaatgagaggaggttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcctgccaccaagacctacataagagatggcatcaagaagcagcagattgattccatcatgtttgaccaggcgcagaccgagatccagtcggtgatggaggaaaatgcctaccagatgtttttgacttctgatatatacctcgaatatgtgaggagtgggggagaaaacacagcttacatgagtaatgggggactcgggagcctaaaggtcgtgtgtggctatctccccaccttgaatgaagaagaggagtggacttgtgccgacttcaagtgcaaactttcgccaaccgtggttggcttgtccagcaaaactctgagggccacggcgagtgtgaggtccacggaaactgttgacagtggatacaggtccttcaagaggagcgatcctgttaatccttatcacataggttctggctatgtctttgcaccagccaccagcgccaacgacagtgagatatccagtgatgcgctgacggatgattccatgtccatgacggacagcagtgtagatggaattcctccttatcgtgtgggcagtaagaaacagctccagagagaaatgcatcgcagtgtgaaggccaatggccaagtgtctctacctcatttcccgagaacccaccgcctgcccaaggagatgacccccgtggaacccgccacctttgcagctgagctgatctcgaggctggaaaagctgaagctggagttggagagccgccacagcctggaggagcgcctgcagcagatccgagaggatgaagagagagagggctccgagctcacactcaattcgcgggagggggcgcccacgcagcaccccctctccctactgccctccggcagctacgaggaagacccgcagacgatactggacgatcacctgtccagggtcctcaagacccctggctgccagtctccgggcgtaggccgctatagccctcgctcccgctccccggaccaccaccaccaccaccattcgcagtaccactccctgctcccgcccggtggcaagctgcctcccgcggccgcctcgccgggcgcctgccccctcctcgggggcaaaggctttgtgaccaagcagacgacgaagcatgtccaccaccactacatccaccaccatgccgtccccaagaccaaggaggagatcgaggcggaggccacgcagcgggtgcactgcttctgccctgggggcagcgagtattactgctactcgaaatgcaaaagccactccaaggctccggaaaccatgcccagcgagcagtttggcggcagcagaggcagtaccttgcccaaacgcaatgggaaaggcacggagccgggcctggccctgcccgccagggaaggaggggcccccggcggagctggggccctgcagcttccccgggaggaaggagacaggtcgcaggatgtctggcagtggatgctggagagtgagcggcagagcaagcccaagccccatagtgcccaaagcacaaaaaaggcctaccccttggagtctgcccgctcgtctccaggcgaacgagccagccggcaccatctgtgggggggcaacagcgggcacccccgcaccaccccccgtgcccacctgttcacccaggaccctgcgatgcctcccctgaccccacccaacacgctggctcagctggaggaggcctgtcgcaggctagctgaggtgtcgaagcccccaaagcagcggtgctgtgtggccagtcagcagagggacaggaatcattcggccactgttcagacgggagccacacccttctccaatccaagcctggctccagaagatcacaaagagccaaagaaactggcaggtgtccacgcgctccaggccagtgagttggttgtcacttactttttctgtggggaagaaattccataccggaggatgctgaaggctcagagcttgaccctgggccactttaaagagcagctcagcaaaaagggaaattataggtattacttcaaaaaagcaagcgatgagtttgcctgtggagcggtgtttgaggagatctgggaggatgagacggtgctcccgatgtatgaaggccggattctgggcaaagtggagcggatcgattgagccctggggtctggctttggtgaactgttggagcccgaagctcttgtgaactgtcttggctgtgagcaactgcgacaaaacattttgaaggaaaattaaaccaatgaagaagacaaagtctaaggaagaatcggccagtgggcttcgggagggcggggggaggttgattttcatgattcatgagctgggtactgactgagataagaaaagcctgaactatttattaaaaacatgaccactcttggctattgaagatgctgcctgtatttgagagactgccatacataatatatgacttcctagggatctgaaatccataaactaagagaaactgtgtatagcttacctgaacaggaatccttactgatatttatagaacagttgatttcccccatccccagtttatggatatgctgctttaaacttgggaagggggagacaggtaagtttt

SEQ ID NO: 301171 - DNA, 3285 bp, Homo sapiens
  misc_feature (1)..(1): n is a, c, g, or t
  misc_feature (4)..(4): n is a, c, g, or t
  misc_feature (6)..(6): n is a, c, g, or t
ngcncnggcggaggctcagtctgcgcgcaggaccggcccaagtccggggcccccgtgtccctcgcgtccctcctcccggcccgggcccctcgcccgtggccgccccggccccttttgcggagaggcagagactccgcgcgtcgccatttctggactaggctgttgctttctgtgctttttctgcgggcgcctctgcaaacggcggcgccggggaccgaccccccgcccgggctcggggcgctgctggcgtgtcccggggttccggcctcgaggtgtgcccgccagggctctggaggcgttcagttgcatttgggccgggggaccgggccggaggggctcggaggacatgagagcctggcttcggcggccttcgtcttccagagaggaggttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcctgccaccaagacctacataagagatggcatcaagaagcagcagattgattccatcatgtttgaccaggcgcagaccgagatccagtcggtgatggaggaaaatgcctaccagatgtttttgacttctgatatatacctcgaatatgtgaggagtgggggagaaaacacagcttacatgagtaatgggggactcgggagcctaaaggtcgtgtgtggctatctccccaccttgaatgaagaagaggagtggacttgtgccgacttcaagtgcaaactttcgccaaccgtggttggcttgtccagcaaaactctgagggccacggcgagtgtgaggtccacggaaactgttgacagtggatacaggtccttcaagaggagcgatcctgttaatccttatcacataggttctggctatgtctttgcaccagccaccagcgccaacgacagtgagatatccagtgatgcgctgacggatgattccatgtccatgacggacagcagtgtagatggaattcctccttatcgtgtgggcagtaagaaacagctccagagagaaatgcatcgcagtgtgaaggccaatggccaagtgtctctacctcatttcccgagaacccaccgcctgcccaaggagatgacccccgtggaacccgccacctttgcagctgagctgatctcgaggctggaaaagctgaagctggagttggagagccgccacagcctggaggagcgcctgcagcagatccgagaggatgaagagagagagggctccgagctcacactcaattcgcgggagggggcgcccacgcagcaccccctctccctactgccctccggcagctacgaggaagacccgcagacgatactggacgatcacctgtccagggtcctcaagacccctggctgccagtctccgggcgtaggccgctatagccctcgctcccgctccccggaccaccaccaccaccaccattcgcagtaccactccctgctcccgcccggtggcaagctgcctcccgcggccgcctcgccgggcgcctgccccctcctcgggggcaaaggctttgtgaccaagcagacgacgaagcatgtccaccaccactacatccaccaccatgccgtccccaagaccaaggaggagatcgaggcggaggccacgcagcgggtgcactgcttctgccctgggggcagcgagtattactgctactcgaaatgcaaaagccactccaaggctccggaaaccatgcccagcgagcagtttggtgcccaaagcacaaaaaaggcctaccccttggagtctgcccgctcgtctccaggcgaacgagccagccggcaccatctgtgggggggcaacagcgggcacccccgcaccaccccccgtgcccacctgttcacccaggaccctgcgatgcctcccctgaccccacccaacacgctggctcagctggaggaggcctgtcgcaggctagctgaggtgtcgaagcccccaaagcagcggtgctgtgtggccagtcagcagagggacaggaatcattcggccactgttcagacgggagccacacccttctccaatccaagcctggctccagaagatcacaaagagccaaagaaactggcaggtgtccacgcgctccaggccagtgagttggttgtcacttactttttctgtggggaagaaattccataccggaggatgctgaaggctcagagcttgaccctgggccactttaaagagcagctcagcaaaaagggaaattataggtattacttcaaaaaagcaagcgatgagtttgcctgtggagcggtgtttgaggagatctgggaggatgagacggtgctcccgatgtatgaaggccggattctgggcaaagtggagcggatcgattgagccctggggtctggctttggtgaactgttggagcccgaagctcttgtgaactgtcttggctgtgagcaactgcgacaaaacattttgaaggaaaattaaaccaatgaagaagacaaagtctaaggaagaatcggccagtgggcttcgggagggcggggggaggttgattttcatgattcatgagctgggtactgactgagataagaaaagcctgaactatttattaaaaacatgaccactcttggctattgaagatgctgcctgtatttgagagactgccatacataatatatgacttcctagggatctgaaatccataaactaagagaaactgtgtatagcttacctgaacaggaatccttactgatatttatagaacagttgatttcccccatccccagtttatggatatgctgctttaaacttgggaagggggagacaggtaagtttt

SEQ ID NO: 301172 - DNA, 1488 bp, Homo sapiens
caccatggcctaggtctgggctggctgcaggccctgcctcatggcctctgagccctccactgccccagggccttgggccctctgcagatctcatccaggatttattggtgtccagtggggtgagggaggcctgtctgaaggccgagcctccctgcctgcacccaagttagaaatgggggtaccagcacttagcttctctctgagtgctggctcccaaggaagggacctgggacctgggccacagtgggggcttgcccttacctcttcagaaggaagcatcttccacagcccccacccaactttcttaggagtgatctggtggccagaacaggattttgcacggccccttttatcctgcgcatgtggcctagggtcatccccagcccatccctgtgtcagccctgagtgctggacactgcgttccagaaatgaggaagaggagagagaagagatggacagacctcagatccattaaagtgttctcacttccctgagacttggttctgggtccttaaaaccaggtttcctaggctgggaccctgtacatagttggtgtttaatgagtgtttatggagaggagagttctaaggtcacctctggctgcaggcatccagggattattccagcaatctgcaggtagggagtgggtcccagcctgggagcctgctgtcaggagcaggcagacctggactcacagcctggctgtgatgcttgttcgctcagcttctccatttatgagatggggagaatagtcacagcctcctcaaagggttgtgaaaatcaaatgtgataatttgtggaaagcccttagcagtggcctggcacaaaacaaatgctcagtggatggaagctgcctattattattgtcgttgttgttgtttgccatgactgctctgggccgggggtagagctagcatccgggcatgtacgagggaagagggaggcaggcctctattcaaaggcagaaattcctttaagattgtggtctgctgggtttcagggagtgtctgtgttgtttgtttttgtttgtttgtttgttttgagacagggtctcgctctgtcacccaggctggagtgtagtggtgcagtcttggctcactgcaacctccacctcctgggctcaagcgattctcatgcctcagcctcccgagtagctgggactacaggtgtgtgccactatgcctggctaatttttgtattttttgtagagacggggttttgccatgttgcccaggctggaagtgtctatgtttaactgcatcttataaaccagcaacaagttttctactgggaattagaatggtgcatacacaatgtattattatcactgtcagatgagcatgcttgaatgtagcatgactgcctctttttgcttttcctagaggttttttttttgcttgttactcatctgttgacctacctgggggaagtagcacccttgcatttcaaaaataaaattgatggcattacaaatggaaaaaaaaacat

SEQ ID NO: 301173 - DNA, 927 bp, Homo sapiens
cctgcagatccagaggcccgtggtgaagaccagcatggagcagctggcccaggagctgcaaggactggcccaggcccaagacaattctgtgctggggcagcggctgcaggaggaggcccaaggactcagaaaccttcaccaggagaaggtcgtcccccagcagagccttgtggcaaagctcaacctcagcgtcagggccctggagtcctctgccccgaatctccagctggagacctcagatgtcctagccaatgtcacctacctgaaaggagagctgcctgcctgggcagccaggatcctgaggaatgtgagtgagtgtttcctggcccgggagatgggctacttctcccagtacgtggcctgggtgagagaggaggtgactcagcgcattgccacctgccagcccctctccggagccctggacaacagccgtgtgatcctgtgtgacatgatggctgacccctggaatgccttctggttctgcctggcatggtgcaccttcttcctgatccccagcatcatctttgccgtcaagacctccaaatacttccgtcctatccggaaacgcctcagctccaccagctctgaggagactcagctcttccacatcccccgggttacctccctgaagctgtagggccttgtggagacggggttttgccatgttgcccaggctggaagtgtctatgtttaactgcatcttataaaccagcaacaagttttctactgggaattagaatggtgcatacacaatgtattattatcactgtcagatgagcatgcttgaatgtagcatgactgcctctttttgcttttcctagaggttttttttttgcttgttactcatctgttgacctacctgggggaagtagcacccttgcatttcaaaaataaaattgatggcattacaaatggaaaaaaaaacat

SEQ ID NO: 301174 - DNA, 687 bp, Homo sapiens
gctgtctcgaggatccctgtggctactgctggagagggctctgcagccagagaggggcctgaggactgtgagtgagtgtttcctggcccgggagatgggctacttctcccagtacgtggcctgggtgagagaggaggtgactcagcgcattgccacctgccagcccctctccggagccctggacaacagccgtgtgatcctgtgtgacatgatggctgacccctggaatgccttctggttctgcctggcatggtgcaccttcttcctgatccccagcatcatctttgccgtcaagacctccaaatacttccgtcctatccggaaacgcctcagctccaccagctctgaggagactcagctcttccacatcccccgggttacctccctgaagctgtagggccttgtggagacggggttttgccatgttgcccaggctggaagtgtctatgtttaactgcatcttataaaccagcaacaagttttctactgggaattagaatggtgcatacacaatgtattattatcactgtcagatgagcatgcttgaatgtagcatgactgcctctttttgcttttcctagaggttttttttttgcttgttactcatctgttgacctacctgggggaagtagcacccttgcatttcaaaaataaaattgatggcattacaaatggaaaaaaaaacat

SEQ ID NO: 301175 - DNA, 1251 bp, Homo sapiens
cctgcagatccagaggcccgtggtgaagaccagcatggagcagctggcccaggagctgcaaggactggcccaggcccaagacaattctgtgctggggcagcggctgcaggaggaggcccaaggactcagaaaccttcaccaggagaaggtcgtcccccagcagagccttgtggcaaagctcaacctcagcgtcagggccctggagtcctctgccccgaatctccagctggagacctcagatgtcctagccaatgtcacctacctgaaaggagagctgcctgcctgggcagccaggatcctgaggaatgtgagtgagtgtttcctggcccgggagatgggctacttctcccagtacgtggcctgggtgagagaggaggtgactcagcgcattgccacctgccagcccctctccggagccctggacaacagccgtgtgatcctgtgtgacatgatggctgacccctggaatgccttctggttctgcctggcatggtgcaccttcttcctgatccccagcatcatctttgccgtcaagacctccaaatacttccgtcctatccggaaacgcctcagctccaccagctctgaggagactcagctcttccacatcccccgggttacctccctgaagctgtagggccttgtgggtgagttttccccaactcgcttaattgctccctgccagggattaagggagtggggtggggaggggctggggtctggggtttccagggcctaggagggcaggaaggcttggggacatggtggagtctgggtattgggtgtggcccatccagcagtggggctgacagccctgttctcccctccctccccttcacccgtttccttcttaatccctgacagggtgaggtgaccctgaggctgcctgtcctcccctttgatttagcctgggccacaggacttcggtagctcttgccccagagcccaggctggcatccaggcctggactgtccccagttccggcttacctggccccaccttgcctgctcctttccacccctttctgctcacgacccccatcattcacgctcagaatcacatgggacttctgtgcagctgcagagccagcaagtccctccaggtgtcaccccttacccccatgctggtggcatcctcacaggaagagcctgttctccacctgctggagcctggaccctggggtgggacagaggcctcgtccaaccccactccccttcccgtgtgtcttccccctgccaagcctccccctgc

SEQ ID NO: 301176 - DNA, 1034 bp, Homo sapiens
cctgcagatccagaggcccgtggtgaagaccagcatggagcagctggcccaggagctgcaaggactggcccaggcccaagacaattctgtgctggggcagcggctgcaggaggaggcccaaggactcagaaaccttcaccaggagaaggtcgtcccccagcagagccttgtggcaaagctcaacctcagcgtcagggccctggagtcctctgccccgaatctccagctggagacctcagatgtcctagccaatgtcacctacctgaaaggagagctgcctgcctgggcagccaggatcctgaggaatgtgagtgagtgtttcctggcccgggagatgggctacttctcccagtacgtggcctgggtgagagaggaggtgactcagcgcattgccacctgccagcccctctccggagccctggacaacagccgtgtgatcctgtgtgacatgatggctgacccctggaatgccttctggttctgcctggcatggtgcaccttcttcctgatccccagcatcatctttgccgtcaagacctccaaatacttccgtcctatccggaaacgcctcagctccaccagctctgaggagactcagctcttccacatcccccgggttacctccctgaagctgtagggccttgtggggtgaggtgaccctgaggctgcctgtcctcccctttgatttagcctgggccacaggacttcggtagctcttgccccagagcccaggctggcatccaggcctggactgtccccagttccggcttacctggccccaccttgcctgctcctttccacccctttctgctcacgacccccatcattcacgctcagaatcacatgggacttctgtgcagctgcagagccagcaagtccctccaggtgtcaccccttacccccatgctggtggcatcctcacaggaagagcctgttctccacctgctggagcctggaccctggggtgggacagaggcctcgtccaaccccactccccttcccgtgtgtcttccccctgccaagcctccccctgc

SEQ ID NO: 301177 - DNA, 310 bp, Homo sapiens
attagagacctcctttctgaaagtgtactgtattggagagagatgaataaaaaatttcctcttctcaagtgttttacttatctcatttaaacctcataacaaccctaggaggtgggtactttcattagcctcattttatcactgacaaaatggaggcttaaagagattaggtgacttgtttaaagtagcacccaatagatggcagagacaagaattgaacgcaggaagtacagctccatagcctgtgcccttaaaacagtgctatatgtgtgatacagcctctgtgtatttcatctcatggtcataagca

SEQ ID NO: 301178 - DNA, 819 bp, Homo sapiens
cgcgggtgggaaccttgacaagcagcatggctgcaggttgctcagaggcgccgcggccagcggcggcttctgatgggtctctggtagggcaggctggcgtcctgccttgcctagagttgccgacttatgccgctgcttgtgcgctggtgaacagtcgctactcatgcctggtggccgggccgcaccaaaggcacatcgcgctgtcgccccgctaccttaacaggaaacgcaccggcattcgagaacagcttgatgcggagctccttcgctattctgagagccttttaggtgtccctattgcatatgataacatcaaagttgtgggagagcttggagatatttatgatgatcaaggacacattcatcttaacattgaagccgattttgttattttctgccctgaaccagggcagaagcttatgggtatagttaataaagtgtcttctagccacattggctgtttagtacatgggtgtttcaatgcctccattcctaaacctgagcagttgtcagctgagcagtggcaaaccatggagataaacatgggtgatgaactagaatttgaagtatttcgtttagactcagatgctgctggagtattctgcattcggggaaaactaaatatcacaagttacattcaagcgctctgagttctgagagttccgaaaggctgaggagtgtaaaaactaaaagagaaagagaagaccggaatttggtggcgtggcccaagtggagtgggaggaaccagggagggggggaaaaaagggggtggggggggcgaaaaaaaaaaacggttgagcgttggggggggcaaaaaat

SEQ ID NO: 301179 - DNA, 4193 bp, Homo sapiens
cgcgggtgggaaccttgacaagcagcatggctgcaggttgctcagaggcgccgcggccagcggcggcttctgatgggtctctggtagggcaggctggcgtcctgccttgcctagagttgccgacttatgccgctgcttgtgcgctggtgaacagtcgctactcatgcctggtggccgggccgcaccaaaggcacatcgcgctgtcgccccgctaccttaacaggaaacgcaccggcattcgagaacagcttgatgcggagctccttcgctattctgagagccttttaggtgtccctattgcatatgataacatcaaagttgtgggagagcttggagatatttatgatgatcaaggacacattcatcttaacattgaagccgattttgttattttctgccctgaaccagggcagaagcttatgggtatagttaataaagtgtcttctagccacattggctgtttagtacatgggtgtttcaatgcctccattcctaaacctgagcagttgtcagctgagcagtggcaaaccatggagataaacatgggtgatgaactagaatttgaagtatttcgtttagactcagatgctgctggagtattctgcattcggggaaaactaaatatcacaagtttacaattcaagcgctctgaagtttctgaagaagttacagaaaatggcactgaggaagctgctaaaaaacctaaaaagaagaaaaagaagaaagacccagagacatatgaagtggacagtggtaccacaaagctagcagatgatgcagatgacactccaatggaagagtcagccctgcagaatactaataatgcgaatggcatctgggaggaggagccaaagaaaaagaagaagaagaaaaagcaccaggaagttcaggaccaggaccctgttttccaaggcagtgactccagtggttaccaaagtgaccataaaaagaaaaaaaagaaaagaaaacacagtgaagaggccgaatttaccccacctttgaaatgctcaccaaaaagaaaagggaaaagtaattttctttagtgtattttaaacacgattcagtttttaaaagatcgatctacatacaatagatgaataaatgttttcagtgatatgaaaaggttaagtatgccagtagtttacaaaacagaaaatacttaactaggagtaggaggctttatatgctaaaaatgataaaactgactgtaaattaatttggggaaagccagtattgttaaaataccattttatacaaaataaaaagctgctctcactgtcagctctcatattcttccaggttttgcactctacataaaattatttctacaatgtcaagactagccaaaggactttataatacaatattatattactaaagaatgagttaagtttgagattttgatgatttgattttgtgtgtgtttaataggcttcaccttattacatgctattttattttgcttttttaaaaactcaggacattaactaattttaggttttcctttatcatggctttctacagtatttctattgtttaacataaaatagtttgccaaagaagtttctgaagtcttcacagctcttaaaagccaggccagtactgactgtgtggtggtaaatgctattcattattttcttttctttcttccaagtgcatgtgtgtccttgtcttcttaagtctgagaggttgctggaaaggactgttttcttgtacttgttcatttgtgcctcagccattctagttttgttgtgtgttggaggacagtctaatgaagacaggataaatgtgattctgactagtgggaaatttcagattactttttaatgattggaatgggctataagatattgtgctgaagagaaaacagttgttctgttcactgctttcattgagaaaatgtggaatgtctcttgactaattgacaaagtgtaatgaaatgacaagctggttgaagctggtaatcaatgcatggccatatttattcattttccacacacttgaccatctactttgtataacacattctgctaaggcccagggatacaatggcaaacaagatagatgtagttccttcccttgtggcatgtcataagagaaacagatgtgcatatacacacaataaataagaaaattaataattgtattaagtggtatgaaaaaaagggggaggattgttcactcactgttacctgtgttagtatctgcaaatgcatgaatggttgaactcccatgtcagcatttttgttgccatttatttagtaccagacatagtgctggtctcacagcttaatatttggtaatgaataaattctgctagtggtatatgttgatctgaacttacaatgatgggatatagaattggcagagtggcagatgttcacaattgtctacaagtagatgtgctagacaatggaaggatgcaggccaacctctttgattacaattgagattcatgtgactattgagccctggaaatgtagcttgtccaaattgagatgtgctgtcagtataaaatacataccagattttaaagatgtaccaaaaaatgtaaactatctcaatttttatattggtgaaatcaatatgtcttggtatagtggcttaaataaaacaattttagcctttctcagtttatttttctgcaaaaagattaaaaattgtacatgaagctcatgttaactttcttttggtcagtgctattttaaaggaagtatgagttgaaaaaaaattgaaataaactatatcatattactaggacttaatatagtggcatacccaggaaatgcttagtaagtgttcccttcacattttaaaatttgagtatacaatcatgtttgacaatatagaaatttaatttttagtgaaacaattctaaaccccttttccatagacacaagaaagatggcaaatttatgctattcctggaaaaatacattgtggcttagcaaataagcaagttcccacgttacttttgttttgcttcaagtaatacttctgccagttgtgttttatgaattaaacagggaacggcatgctgaacttgaaactagatttgttcctgcttttttcacaatgtgagtagttttgaaaagtcagatctggccatttgtctttcctagaatagcataactttgttcattgttttttttgtttgtctttctgacacagaaagactgatgatggtgtccactatgtattcttcaaaacatttggcacatgctgcactaacctagtctatcttttctatcttggaatttgctcatacaaaccctatagcctagactagatcccttaccctctctccagttcctatcattcacccatttcactgtgcaagacacctcactagtcaccagtgatacagaaatgacttttaagcagtttctgctcttaagggcttaccgttttgtctataagatacacaagtataaatgacaagtacaaataacaatgaatgtttaatgctttacgtttagtgtttaagcttgttgttggaagagcagcattttgacccttggagaagaaaaactagctgtggcattccaggtggagaacctgacagaggactaagaagttatctaatgtaaaagacctcaggcaccaccttcgcataaactttttccagacaaggctaaatgtgcatgcttcataaccataattcttatttttctttaataaatatttttctacttgtaacactgtgcattatttcaaactgtttacctgtttgtaaagcttgtctcttaatcaaatttgtcttgaccaaataagtttcctgagggctggaattatgccttaactatatctatagtatttaacagtgaatcctttgtataatgaaagcatcaacagataattttaaattgataaataaaaagcacagtttcaaatggtaaaaaaaacaccacaacaaccaacaacacgttgtggggtgactcggccctggaaagagtttcaaacccatgcggtgggccgggccccatagcacgggcactggcatacgtggcaaagaacagcggctcagcacaggcgtggttccccccataaaaagccgcgggaacgcgggttggaaaccgagggtcggagcaaggtcaacaaggccggcctacctcccccgtgggaggtaaaagaatacacgaaatgacagaaaaaaaagcggacacagaagagaaaaaaaagaggaaagaaca

SEQ ID NO: 301180 - DNA, 4140 bp, Homo sapiens
cgcgggtgggaaccttgacaagcagcatggctgcaggttgctcagaggcgccgcggccagcggcggcttctgatgggtctctggtagggcaggctggcgtcctgccttgcctagagttgccgacttatgccgctgcttgtgcgctggtgaacagtcgctactcatgcctggtggccgggccgcaccaaaggcacatcgcgctgtcgccccgctaccttaacaggaaacgcaccggcattcgagaacagcttgatgcggagctccttcgctattctgagagccttttaggtgtccctattgcatatgataacatcaaagttgtgggagagcttggagatatttatgatgatcaaggacacattcatcttaacattgaagccgattttgttattttctgccctgaaccagggcagaagcttatgggtatagttaataaagtgtcttctagccacattggctgtttagtacatgggtgtttcaatgcctccattcctaaacctgagcagttgtcagctgagcagtggcaaaccatggagataaacatgggtgatgaactagaatttgaagtatttcgtttagactcagatgctgctggagtattctgcattcggggaaaactaaatatcacaagtttacaattcaagcgctctgaagtttctgaagaagttacagaaaatggcactgaggaagctgctaaaaaacctaaaaagaagaaaaagaagaaagacccagagacatatgaagtggacagtggtaccacaaagctagcagatgatgcagatgacactccaatggaagagtcagccctgcagaatactaataatgcgaatggcatctgggaggaggagccaaagaaaaagaagaagaagaaaaagcaccaggaagttcaggaccaggaccctgttttccaaggcagtgactccagtggttaccaaagtgaccataaaaagaaaaaaaagaaaagaaaacacagtgaagaggccgaatttaccccacctttgaaatgctcaccaaaaagaaaagggaaaagtaattttctttagtgtattttaaacacgattcagtttttaaaagatcgatctacatacaatagatgaataaatgttttcagtgatatgaaaaggttaagtatgccagtagtttacaaaacagaaaatacttaactaggagtaggaggctttatatgctaaaaatgataaaactgactgtaaattaatttggggaaagccagtattgttaaaataccattttatacaaaataaaaagctgctctcactgtcagctctcatattcttccaggttttgcactctacataaaattatttctacaatgtcaagactagccaaaggactttataatacaatattatattactaaagaatgagttaagtttgagattttgatgatttgattttgtgtgtgtttaataggcttcaccttattacatgctattttattttgcttttttaaaaactcaggacattaactaattttaggttttcctttatcatggctttctacagtatttctattgtttaacataaaatagtttgccaaagaagtttctgaagtcttcacagcttcttttctttcttccaagtgcatgtgtgtccttgtcttcttaagtctgagaggttgctggaaaggactgttttcttgtacttgttcatttgtgcctcagccattctagttttgttgtgtgttggaggacagtctaatgaagacaggataaatgtgattctgactagtgggaaatttcagattactttttaatgattggaatgggctataagatattgtgctgaagagaaaacagttgttctgttcactgctttcattgagaaaatgtggaatgtctcttgactaattgacaaagtgtaatgaaatgacaagctggttgaagctggtaatcaatgcatggccatatttattcattttccacacacttgaccatctactttgtataacacattctgctaaggcccagggatacaatggcaaacaagatagatgtagttccttcccttgtggcatgtcataagagaaacagatgtgcatatacacacaataaataagaaaattaataattgtattaagtggtatgaaaaaaagggggaggattgttcactcactgttacctgtgttagtatctgcaaatgcatgaatggttgaactcccatgtcagcatttttgttgccatttatttagtaccagacatagtgctggtctcacagcttaatatttggtaatgaataaattctgctagtggtatatgttgatctgaacttacaatgatgggatatagaattggcagagtggcagatgttcacaattgtctacaagtagatgtgctagacaatggaaggatgcaggccaacctctttgattacaattgagattcatgtgactattgagccctggaaatgtagcttgtccaaattgagatgtgctgtcagtataaaatacataccagattttaaagatgtaccaaaaaatgtaaactatctcaatttttatattggtgaaatcaatatgtcttggtatagtggcttaaataaaacaattttagcctttctcagtttatttttctgcaaaaagattaaaaattgtacatgaagctcatgttaactttcttttggtcagtgctattttaaaggaagtatgagttgaaaaaaaattgaaataaactatatcatattactaggacttaatatagtggcatacccaggaaatgcttagtaagtgttcccttcacattttaaaatttgagtatacaatcatgtttgacaatatagaaatttaatttttagtgaaacaattctaaaccccttttccatagacacaagaaagatggcaaatttatgctattcctggaaaaatacattgtggcttagcaaataagcaagttcccacgttacttttgttttgcttcaagtaatacttctgccagttgtgttttatgaattaaacagggaacggcatgctgaacttgaaactagatttgttcctgcttttttcacaatgtgagtagttttgaaaagtcagatctggccatttgtctttcctagaatagcataactttgttcattgttttttttgtttgtctttctgacacagaaagactgatgatggtgtccactatgtattcttcaaaacatttggcacatgctgcactaacctagtctatcttttctatcttggaatttgctcatacaaaccctatagcctagactagatcccttaccctctctccagttcctatcattcacccatttcactgtgcaagacacctcactagtcaccagtgatacagaaatgacttttaagcagtttctgctcttaagggcttaccgttttgtctataagatacacaagtataaatgacaagtacaaataacaatgaatgtttaatgctttacgtttagtgtttaagcttgttgttggaagagcagcattttgacccttggagaagaaaaactagctgtggcattccaggtggagaacctgacagaggactaagaagttatctaatgtaaaagacctcaggcaccaccttcgcataaactttttccagacaaggctaaatgtgcatgcttcataaccataattcttatttttctttaataaatatttttctacttgtaacactgtgcattatttcaaactgtttacctgtttgtaaagcttgtctcttaatcaaatttgtcttgaccaaataagtttcctgagggctggaattatgccttaactatatctatagtatttaacagtgaatcctttgtataatgaaagcatcaacagataattttaaattgataaataaaaagcacagtttcaaatggtaaaaaaaacaccacaacaaccaacaacacgttgtggggtgactcggccctggaaagagtttcaaacccatgcggtgggccgggccccatagcacgggcactggcatacgtggcaaagaacagcggctcagcacaggcgtggttccccccataaaaagccgcgggaacgcgggttggaaaccgagggtcggagcaaggtcaacaaggccggcctacctcccccgtgggaggtaaaagaatacacgaaatgacagaaaaaaaagcggacacagaagagaaaaaaaagaggaaagaaca

SEQ ID NO: 301181 - DNA, 4056 bp, Homo sapiens
ttagtttatccagttagaaagttaatgtgcccagttagacagttaatgtgcaattacttatataataaagtttgagctttctcaaaacccagtggtattctaaagtgatgttttggcatgacatgtggtaagttttaattgaggtaaactttttccatattaaattagaccattaatttgatgtttgttctttgaagattatttgaagcttgtaaagtttggttcaccttttaactttgtggatgtgttctttatgttacgctctttcttccttcttcttcccagggtatagttaataaagtgtcttctagccacattggctgtttagtacatgggtgtttcaatgcctccattcctaaacctgagcagttgtcagctgagcagtggcaaaccatggagataaacatgggtgatgaactagaatttgaagtatttcgtttagactcagatgctgctggagtattctgcattcggggaaaactaaatatcacaagtttacaattcaagcgctctgaagtttctgaagaagttacagaaaatggcactgaggaagctgctaaaaaacctaaaaagaagaaaaagaagaaagacccagagacatatgaagtggacagtggtaccacaaagctagcagatgatgcagatgacactccaatggaagagtcagccctgcagaatactaataatgcgaatggcatctgggaggaggagccaaagaaaaagaagaagaagaaaaagcaccaggaagttcaggaccaggaccctgttttccaaggcagtgactccagtggttaccaaagtgaccataaaaagaaaaaaaagaaaagaaaacacagtgaagaggccgaatttaccccacctttgaaatgctcaccaaaaagaaaagggaaaagtaattttctttagtgtattttaaacacgattcagtttttaaaagatcgatctacatacaatagatgaataaatgttttcagtgatatgaaaaggttaagtatgccagtagtttacaaaacagaaaatacttaactaggagtaggaggctttatatgctaaaaatgataaaactgactgtaaattaatttggggaaagccagtattgttaaaataccattttatacaaaataaaaagctgctctcactgtcagctctcatattcttccaggttttgcactctacataaaattatttctacaatgtcaagactagccaaaggactttataatacaatattatattactaaagaatgagttaagtttgagattttgatgatttgattttgtgtgtgtttaataggcttcaccttattacatgctattttattttgcttttttaaaaactcaggacattaactaattttaggttttcctttatcatggctttctacagtatttctattgtttaacataaaatagtttgccaaagaagtttctgaagtcttcacagctcttaaaagccaggccagtactgactgtgtggtggtaaatgctattcattattttcttttctttcttccaagtgcatgtgtgtccttgtcttcttaagtctgagaggttgctggaaaggactgttttcttgtacttgttcatttgtgcctcagccattctagttttgttgtgtgttggaggacagtctaatgaagacaggataaatgtgattctgactagtgggaaatttcagattactttttaatgattggaatgggctataagatattgtgctgaagagaaaacagttgttctgttcactgctttcattgagaaaatgtggaatgtctcttgactaattgacaaagtgtaatgaaatgacaagctggttgaagctggtaatcaatgcatggccatatttattcattttccacacacttgaccatctactttgtataacacattctgctaaggcccagggatacaatggcaaacaagatagatgtagttccttcccttgtggcatgtcataagagaaacagatgtgcatatacacacaataaataagaaaattaataattgtattaagtggtatgaaaaaaagggggaggattgttcactcactgttacctgtgttagtatctgcaaatgcatgaatggttgaactcccatgtcagcatttttgttgccatttatttagtaccagacatagtgctggtctcacagcttaatatttggtaatgaataaattctgctagtggtatatgttgatctgaacttacaatgatgggatatagaattggcagagtggcagatgttcacaattgtctacaagtagatgtgctagacaatggaaggatgcaggccaacctctttgattacaattgagattcatgtgactattgagccctggaaatgtagcttgtccaaattgagatgtgctgtcagtataaaatacataccagattttaaagatgtaccaaaaaatgtaaactatctcaatttttatattggtgaaatcaatatgtcttggtatagtggcttaaataaaacaattttagcctttctcagtttatttttctgcaaaaagattaaaaattgtacatgaagctcatgttaactttcttttggtcagtgctattttaaaggaagtatgagttgaaaaaaaattgaaataaactatatcatattactaggacttaatatagtggcatacccaggaaatgcttagtaagtgttcccttcacattttaaaatttgagtatacaatcatgtttgacaatatagaaatttaatttttagtgaaacaattctaaaccccttttccatagacacaagaaagatggcaaatttatgctattcctggaaaaatacattgtggcttagcaaataagcaagttcccacgttacttttgttttgcttcaagtaatacttctgccagttgtgttttatgaattaaacagggaacggcatgctgaacttgaaactagatttgttcctgcttttttcacaatgtgagtagttttgaaaagtcagatctggccatttgtctttcctagaatagcataactttgttcattgttttttttgtttgtctttctgacacagaaagactgatgatggtgtccactatgtattcttcaaaacatttggcacatgctgcactaacctagtctatcttttctatcttggaatttgctcatacaaaccctatagcctagactagatcccttaccctctctccagttcctatcattcacccatttcactgtgcaagacacctcactagtcaccagtgatacagaaatgacttttaagcagtttctgctcttaagggcttaccgttttgtctataagatacacaagtataaatgacaagtacaaataacaatgaatgtttaatgctttacgtttagtgtttaagcttgttgttggaagagcagcattttgacccttggagaagaaaaactagctgtggcattccaggtggagaacctgacagaggactaagaagttatctaatgtaaaagacctcaggcaccaccttcgcataaactttttccagacaaggctaaatgtgcatgcttcataaccataattcttatttttctttaataaatatttttctacttgtaacactgtgcattatttcaaactgtttacctgtttgtaaagcttgtctcttaatcaaatttgtcttgaccaaataagtttcctgagggctggaattatgccttaactatatctatagtatttaacagtgaatcctttgtataatgaaagcatcaacagataattttaaattgataaataaaaagcacagtttcaaatggtaaaaaaaacaccacaacaaccaacaacacgttgtggggtgactcggccctggaaagagtttcaaacccatgcggtgggccgggccccatagcacgggcactggcatacgtggcaaagaacagcggctcagcacaggcgtggttccccccataaaaagccgcgggaacgcgggttggaaaccgagggtcggagcaaggtcaacaaggccggcctacctcccccgtgggaggtaaaagaatacacgaaatgacagaaaaaaaagcggacacagaagagaaaaaaaagaggaaagaaca

SEQ ID NO: 301182 - DNA, 4105 bp, Homo sapiens
cgcgggtgggaaccttgacaagcagcatggctgcaggttgctcagaggcgccgcggccagcggcggcttctgatgggtctctggtagggcaggctggcgtcctgccttgcctagagttgccgacttatgccgctgcttgtgcgctggtgaacagtcgctactcatgcctggtggccgggccgcaccaaaggcacatcgcgctgtcgccccgctaccttaacaggaaacgcaccggcattcgagaacagcttgatgcggagctccttcgctattctgagagccttttaggtgtccctattgcatatgataacatcaaagttgtgggagagcttggagatatttatgatgatcaaggacacattcatcttaacattgaagccgattttgttattttctgccctgaaccagggcagaagcttatgggtatagttaataaagtgtcttctagccacattggctgtttagtacatgggtgtttcaatgcctccattcctaaacctgagcagttgtcagctgagcagtggcaaaccatggagataaacatgggtgatgaactagaatttgaatttctgaagaagttacagaaaatggcactgaggaagctgctaaaaaacctaaaaagaagaaaaagaagaaagacccagagacatatgaagtggacagtggtaccacaaagctagcagatgatgcagatgacactccaatggaagagtcagccctgcagaatactaataatgcgaatggcatctgggaggaggagccaaagaaaaagaagaagaagaaaaagcaccaggaagttcaggaccaggaccctgttttccaaggcagtgactccagtggttaccaaagtgaccataaaaagaaaaaaaagaaaagaaaacacagtgaagaggccgaatttaccccacctttgaaatgctcaccaaaaagaaaagggaaaagtaattttctttagtgtattttaaacacgattcagtttttaaaagatcgatctacatacaatagatgaataaatgttttcagtgatatgaaaaggttaagtatgccagtagtttacaaaacagaaaatacttaactaggagtaggaggctttatatgctaaaaatgataaaactgactgtaaattaatttggggaaagccagtattgttaaaataccattttatacaaaataaaaagctgctctcactgtcagctctcatattcttccaggttttgcactctacataaaattatttctacaatgtcaagactagccaaaggactttataatacaatattatattactaaagaatgagttaagtttgagattttgatgatttgattttgtgtgtgtttaataggcttcaccttattacatgctattttattttgcttttttaaaaactcaggacattaactaattttaggttttcctttatcatggctttctacagtatttctattgtttaacataaaatagtttgccaaagaagtttctgaagtcttcacagctcttaaaagccaggccagtactgactgtgtggtggtaaatgctattcattattttcttttctttcttccaagtgcatgtgtgtccttgtcttcttaagtctgagaggttgctggaaaggactgttttcttgtacttgttcatttgtgcctcagccattctagttttgttgtgtgttggaggacagtctaatgaagacaggataaatgtgattctgactagtgggaaatttcagattactttttaatgattggaatgggctataagatattgtgctgaagagaaaacagttgttctgttcactgctttcattgagaaaatgtggaatgtctcttgactaattgacaaagtgtaatgaaatgacaagctggttgaagctggtaatcaatgcatggccatatttattcattttccacacacttgaccatctactttgtataacacattctgctaaggcccagggatacaatggcaaacaagatagatgtagttccttcccttgtggcatgtcataagagaaacagatgtgcatatacacacaataaataagaaaattaataattgtattaagtggtatgaaaaaaagggggaggattgttcactcactgttacctgtgttagtatctgcaaatgcatgaatggttgaactcccatgtcagcatttttgttgccatttatttagtaccagacatagtgctggtctcacagcttaatatttggtaatgaataaattctgctagtggtatatgttgatctgaacttacaatgatgggatatagaattggcagagtggcagatgttcacaattgtctacaagtagatgtgctagacaatggaaggatgcaggccaacctctttgattacaattgagattcatgtgactattgagccctggaaatgtagcttgtccaaattgagatgtgctgtcagtataaaatacataccagattttaaagatgtaccaaaaaatgtaaactatctcaatttttatattggtgaaatcaatatgtcttggtatagtggcttaaataaaacaattttagcctttctcagtttatttttctgcaaaaagattaaaaattgtacatgaagctcatgttaactttcttttggtcagtgctattttaaaggaagtatgagttgaaaaaaaattgaaataaactatatcatattactaggacttaatatagtggcatacccaggaaatgcttagtaagtgttcccttcacattttaaaatttgagtatacaatcatgtttgacaatatagaaatttaatttttagtgaaacaattctaaaccccttttccatagacacaagaaagatggcaaatttatgctattcctggaaaaatacattgtggcttagcaaataagcaagttcccacgttacttttgttttgcttcaagtaatacttctgccagttgtgttttatgaattaaacagggaacggcatgctgaacttgaaactagatttgttcctgcttttttcacaatgtgagtagttttgaaaagtcagatctggccatttgtctttcctagaatagcataactttgttcattgttttttttgtttgtctttctgacacagaaagactgatgatggtgtccactatgtattcttcaaaacatttggcacatgctgcactaacctagtctatcttttctatcttggaatttgctcatacaaaccctatagcctagactagatcccttaccctctctccagttcctatcattcacccatttcactgtgcaagacacctcactagtcaccagtgatacagaaatgacttttaagcagtttctgctcttaagggcttaccgttttgtctataagatacacaagtataaatgacaagtacaaataacaatgaatgtttaatgctttacgtttagtgtttaagcttgttgttggaagagcagcattttgacccttggagaagaaaaactagctgtggcattccaggtggagaacctgacagaggactaagaagttatctaatgtaaaagacctcaggcaccaccttcgcataaactttttccagacaaggctaaatgtgcatgcttcataaccataattcttatttttctttaataaatatttttctacttgtaacactgtgcattatttcaaactgtttacctgtttgtaaagcttgtctcttaatcaaatttgtcttgaccaaataagtttcctgagggctggaattatgccttaactatatctatagtatttaacagtgaatcctttgtataatgaaagcatcaacagataattttaaattgataaataaaaagcacagtttcaaatggtaaaaaaaacaccacaacaaccaacaacacgttgtggggtgactcggccctggaaagagtttcaaacccatgcggtgggccgggccccatagcacgggcactggcatacgtggcaaagaacagcggctcagcacaggcgtggttccccccataaaaagccgcgggaacgcgggttggaaaccgagggtcggagcaaggtcaacaaggccggcctacctcccccgtgggaggtaaaagaatacacgaaatgacagaaaaaaaagcggacacagaagagaaaaaaaagaggaaagaaca

SEQ ID NO: 301183 - DNA, 2102 bp, Homo sapiens
cgcgggtgggaaccttgacaagcagcatggctgcaggttgctcagaggcgccgcggccagcggcggcttctgatgggtctctggtagggcaggctggcgtcctgccttgcctagagttgccgacttatgccgctgcttgtgcgctggtgaacagtcgctactcatgcctggtggccgggccgcaccaaaggcacatcgcgctgtcgccccgctaccttaacaggaaacgcaccggcattcgagaacagcttgatgcggagctccttcgctattctgagagccttttaggtgtccctattgcatatgataacatcaaagttgtgggagagcttggagatatttatgatgatcaaggacacattcatcttaacattgaagccgattttgttattttctgccctgaaccagggcagaagcttatgggtatagttaataaagtgtcttctagccacattggctgtttagtacatgggtgtttcaatgcctccattcctaaacctgagcagttgtcagctgagcagtggcaaaccatggagataaacatgggtgatgaactagaatttgaagtatttcgtttagactcagatgctgctggagtattctgcattcggggaaaactaaatatcacaagtttacaattcaagcgctctgaagtttctgaagaagttacagaaaatggcactgaggaagctgctaaaaaacctaaaaagaagaaaaagaagaaagacccagagacatatgaagtggacagtggtaccacaaagctagcagatgatgcagatgacactccaatggaagagtcagccctgcagaatactaataatgcgaatggcatctgggaggaggagccaaagaaaaagaagaagaagaaaaagcaccaggaagttcaggaccaggaccctgttttccaaggcagtgactccagtggttaccaaagtgaccataaaaagaaaaaaaagaaaagaaaacacagtgaagaggccgaatttaccccacctttgaaatgctcaccaaaaagaaaagggaaaagtaattttctttagtgtattttaaacacgattcagtttttaaaagatcgatctacatacaatagatgaataaatgttttcagtgatatgaaaaggttaagtatgccagtagtttacaaaacagaaaatacttaactaggagtaggaggctttatatgctaaaaatgataaaactgactgtaaattaatttggggaaagccagtattgttaaaataccattttatacaaaataaaaagctgctctcactgtcagctctcatattcttccaggttttgcactctacataaaattatttctacaatgtcaagactagccaaaggactttataatacaatattatattactaaagaatgagttaagtttgagattttgatgatttgattttgtgtgtgtttaataggcttcaccttattacatgctattttattttgcttttttaaaaactcaggacattaactaattttaggttttcctttatcatggctttctacagtatttctattgtttaacataaaatagtttgccaaagaagtttctgaagtcttcacagctcttaaaagccaggccagtactgactgtgtggtggtaaatgctattcattattttcttttctttcttccaagtgcatgtgtgtccttgtcttcttaagtctgagaggttgctggaaaggactgttttcttgtacttgttcatttgtgcctcagccattctagttttgttgtgtgttggaggacagtctaatgaagacaggataaatgtgattctgactagtgggaaatttcagattactttttaatgattggaatgggctataagatattgtgctgaagagaaaacagttgttctgttcactgctttcattgagaaaatgtggaatgtctcttgactaattgacaaagtgtaatgaaatgacaagctggttgaagctggtaatcaatgcatggccatatttattcattttccacacacttgaccatctactttgtatatgcacatctgtttctcttatgacatgccacaagggaaggaactacatctatcttgtttgccattgtaatccctgggccttag

SEQ ID NO: 301184 - DNA, 1343 bp, Homo sapiens
cgcgggtgggaaccttgacaagcagcatggctgcaggttgctcagaggcgccgcggccagcggcggcttctgatgggtctctggtagggcaggctggcgtcctgccttgcctagagttgccgacttatgccgctgcttgtgcgctggtgaacagtcgctactcatgcctggtggccgggccgcaccaaaggcacatcgcgctgtcgccccgctaccttaacaggaaacgcaccggcattcgagaacagcttgatgcggagctccttcgctattctgagagccttttaggtgtccctattgcatatgataacatcaaagttgtgggagagcttggagatatttatgatgatcaaggacacattcatcttaacattgaagccgattttgttattttctgccctgaaccagggcagaagcttatgggtatagttaataaagtgtcttctagccacattggctgtttagtacatgggtgtttcaatgcctccattcctaaacctgagcagttgtcagctgagcagtggcaaaccatggagataaacatgggtgatgaactagaatttgaagtatttcgtttagactcagatgctgctggagtattctgcattcggggaaaactaaatatcacaagtttacaattcaagcgctctgaagtttctgaagaagttacagaaaatggcactgaggaagctgctaaaaaacctaaaaagaagaaaaagaagaaagacccagagacatatgaagtggacagtggtaccacaaagctagcagatgatgcagatgacactccaatggaagagtcagccctgcagaatactaataatgcgaatggcatctgggaggaggagccaaagaaaaagaagaagaagaaaaagcaccaggaagttcaggaccaggaccctgttttccaaggcagtgactccagtggttaccaaagtgaccataaaaagaaaaaaaagaaaagaaaacacagtgaagaggccgaatttaccccacctttgaaatgctcaccaaaaagaaaagggaaaagtaattttctttagtgtattttaaacacgattcagtttttaaaagatcgatctacatacaatagatgaataaatgttttcagtgatatgaaaaggttaagtatgccagtagtttacaaaacagaaaatacttaactaggagtaggaggctttatatgctattgaaacttctaaaactcctagttttagaagtttcaatagcactctaccaaaggtgggggaacagtggggagaaacatcaactcatctttgaagaagctacatcttctctcatctctatcaggtctgatggcaacaccaacacatcagaacaca

SEQ ID NO: 301185 - DNA, 866 bp, Homo sapiens
cgtcgacagtgatacagaaatgacttttaagcagtttctgctcttaagggcttaccgtttctgctcttaagggcttaccgttttgtctataagatacacaagtataaatgacaagtacaaataacaatgaatgtttaatgctttacgtttagtgtttaagcttgttgttggaagagcagcattttgacccttggagaagaaaaactagctgtggcattccaggtggagaacctgacagaggactaagaagttatctaatgtaaaagacctcaggcaccaccttcgcataaactttttccagacaaggctaaatgtgcatgcttcataaccataattcttatttttctttaataaatatttttctacttgtaacactgtgcattatttcaaactgtttacctgtttgtaaagcttgtctcttaatcaaatttgtcttgaccaaataagtttcctgagggctggaattatgccttaactatatctatagtatttaacagtgaatcctttgtataatgaaagcatcaacagataattttaaattgataaataaaaagcacagtttcaaatggtaaaaaaaacaccacaacaaccaacaacacgttgtggggtgactcggccctggaaagagtttcaaacccatgcggtgggccgggccccatagcacgggcactggcatacgtggcaaagaacagcggctcagcacaggcgtggttccccccataaaaagccgcgggaacgcgggttggaaaccgagggtcggagcaaggtcaacaaggccggcctacctcccccgtgggaggtaaaagaatacacgaaatgacagaaaaaaaagcggacacagaagagaaaaaaaagaggaaagaaca

SEQ ID NO: 301186 - DNA, 4261 bp, Homo sapiens
cccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcgccgccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaaaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaattttcgctgcaggtgtcaactctgaaatggtcaagctttatgaccttcgttcttttgataaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttgggggttatgccaacagcaaagctgtcacactggaggcttcatttactccagactctcagtttattatgattggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccacccctttccccagctcccaaccaagagctggttctaggcctgtgttatatgtcatatttagcgtttttatatatgacctttgatttctgttgtttgtattttagcacagtgtatgcaccttcatttaaatacatctgtgtgcatacagatacgcatatatgtgtgtgcgtatgcatatatctctcatctgtagtttccaagagttcagctgaagcagatggagtcctgcagcccaggagacaccctgcatccctgctaatagtgtttgccacaagtattagtgagtcttccttattaatattttcatttcagaagactgaagcaaagctgatagtgtttgctgtttctttggcagctaagtgagggtcttgggatgacttgctgtgttcctcaagctgcactttggggccatctctgcagtattagccccctttttgcttggtggtactctgtctgtgcctgtgtgtgtgtgtgatagtcactcttgcatggcttccatgtctggtttgtggcatttggggataaggtgctgaagccagagcatttgcagtttgtttgaggcctcgttgccaatgatagatcactcctgttgacctggtatgtctgcttgcttgctgcttttccttgctttctcttggaagaggaaaggactctggtcaggcccaggctgagtgagatgagctgcagctggctcatggccttcttagagcagagagaggagtatgtcattttactaagttcctaaacaaacatttatgcaggcaacactccttgcagatccagaaactgaggcacaatagggttatgacttgctcaagaatatgtagctgctagggggtaaatcaaggcatcacaatttctgttcagcgggcaggaataggctgtgaattgctagcactttttttttttaagcaattactttttgacttgttcctctgaaagtgcaagaggcgtacacctttcccaaatgtagactagaatctgcaggatgccacccactgtatagttctgctttcccagagaggaagaacttttagaaaccaaatgatcttaattgttattgcccacccctggcttttccgggtagaaaattcacagtaggaatgattgttaagagagagtgcttggaaccatgggttaacaggaaaggctacctaacttcacatatctgcaaccagagcagccaccaagcattacttagcagcaggaaaatgattgtatttgagttcctgtgtgtccaaaactgaggcaccatgttctttgaaaacatgccacctcaaggctgggcgcggtggctcacacctgtaatcccagcactttgggaggccgaggcgggcggatcaccggaggtcgggagtttgagaccagcctgaccaacatggagaaaccccatctctactaaaaatacaaaattagccgggcgtggtggcatgcgcctataatctcagctacttgggaggctgaggcaggagaattgcttgaacccaggaggcggaggttgcggtgagttgagatcgtgccattgcactccggcctgggcaacaacagcaaaactccgtctcaaaaaaaaaaaaaaaaaaattgccacctcacagtctctatcgttgggccctgtggttgcaaagctgcctcctgaattaagaaggaaagggaaaagatatagctggaagcgagtggaagagatgctgagggctggggctgcacagacgtgctcagcagggctacaggtgctcaagccctattggggatgggtggggagtggggcagcggcgtttgccaccttaagaattggggccaaagccactgatgtttatttgacagtgacactgcactgggtacttaaagaaattatttcccgttgtaattataattactgcttattaaggaaaatatgggaattttagaaagaatcaagtttgccacccaaatgctaccactgttaatcttttggtgttaaatgttccccctagacatttctgtgcatagatttttggtgtgtttacatagtcgttattctgtatatacaattttatgtcccttttgtacttaacgtataaacattttttccatgttacagtctt

SEQ ID NO: 301187 - DNA, 3888 bp, Homo sapiens
atctcctactctggtgcgtcttatgacttgccagagaggtggcaatccaccgataaccctgttacagtaagaaatatggagtggacctcatcaaataccctcatgtcaacgaacacagttgtatagggcttctaacaaacatagacgatactatactgttgctttccttgtctgatagatcaacactacactcatgatagtcttcccggacatcccgatagcggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaattttcgctgcaggtgtcaactctgaaatggtcaagctttatgaccttcgttcttttgataaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttgggggttatgccaacagcaaagctgtcacactggaggcttcatttactccagactctcagtttattatgattggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccacccctttccccagctcccaaccaagagctggttctaggcctgtgttatatgtcatatttagcgtttttatatatgacctttgatttctgttgtttgtattttagcacagtgtatgcaccttcatttaaatacatctgtgtgcatacagatacgcatatatgtgtgtgcgtatgcatatatctctcatctgtagtttccaagagttcagctgaagcagatggagtcctgcagcccaggagacaccctgcatccctgctaatagtgtttgccacaagtattagtgagtcttccttattaatattttcatttcagaagactgaagcaaagctgatagtgtttgctgtttctttggcagctaagtgagggtcttgggatgacttgctgtgttcctcaagctgcactttggggccatctctgcagtattagccccctttttgcttggtggtactctgtctgtgcctgtgtgtgtgtgtgatagtcactcttgcatggcttccatgtctggtttgtggcatttggggataaggtgctgaagccagagcatttgcagtttgtttgaggcctcgttgccaatgatagatcactcctgttgacctggtatgtctgcttgcttgctgcttttccttgctttctcttggaagaggaaaggactctggtcaggcccaggctgagtgagatgagctgcagctggctcatggccttcttagagcagagagaggagtatgtcattttactaagttcctaaacaaacatttatgcaggcaacactccttgcagatccagaaactgaggcacaatagggttatgacttgctcaagaatatgtagctgctagggggtaaatcaaggcatcacaatttctgttcagcgggcaggaataggctgtgaattgctagcactttttttttttaagcaattactttttgacttgttcctctgaaagtgcaagaggcgtacacctttcccaaatgtagactagaatctgcaggatgccacccactgtatagttctgctttcccagagaggaagaacttttagaaaccaaatgatcttaattgttattgcccacccctggcttttccgggtagaaaattcacagtaggaatgattgttaagagagagtgcttggaaccatgggttaacaggaaaggctacctaacttcacatatctgcaaccagagcagccaccaagcattacttagcagcaggaaaatgattgtatttgagttcctgtgtgtccaaaactgaggcaccatgttctttgaaaacatgccacctcaaggctgggcgcggtggctcacacctgtaatcccagcactttgggaggccgaggcgggcggatcaccggaggtcgggagtttgagaccagcctgaccaacatggagaaaccccatctctactaaaaatacaaaattagccgggcgtggtggcatgcgcctataatctcagctacttgggaggctgaggcaggagaattgcttgaacccaggaggcggaggttgcggtgagttgagatcgtgccattgcactccggcctgggcaacaacagcaaaactccgtctcaaaaaaaaaaaaaaaaaaattgccacctcacagtctctatcgttgggccctgtggttgcaaagctgcctcctgaattaagaaggaaagggaaaagatatagctggaagcgagtggaagagatgctgagggctggggctgcacagacgtgctcagcagggctacaggtgctcaagccctattggggatgggtggggagtggggcagcggcgtttgccaccttaagaattggggccaaagccactgatgtttatttgacagtgacactgcactgggtacttaaagaaattatttcccgttgtaattataattactgcttattaaggaaaatatgggaattttagaaagaatcaagtttgccacccaaatgctaccactgttaatcttttggtgttaaatgttccccctagacatttctgtgcatagatttttggtgtgtttacatagtcgttattctgtatatacaattttatgtcccttttgtacttaacgtataaacattttttccatgttacagtctt

SEQ ID NO: 301188 - DNA, 4436 bp, Homo sapiens
cccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcgccgccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaaaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaattttcgctgcaggtgtcaactctgaaatggtcaagctttatgaccttcgttcttttgataaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttgggggttatgccaacagcaaagctgtcacactggaggcttcatttactccagactctcagtttattatgattggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccacccctttccccagctcccaaccaagagctggttctaggcctgtgttatatgtcatatttagcgtttttatatatgacctttgatttctgttgtttgtattttagcacagtgtatgcaccttcatttaaatacatctgtgtgcatacagatacgcatatatgtgtgtgcgtatgcatatatctctcatctgtagtttccaagagttcagctgaagcagatggagtcctgcagcccaggagacaccctgcatccctgctaatagtgtttgccacaagtattagtgagtcttccttattaatattttcatttcagaagactgaagcaaagctgatagtgtttgctgtttctttggcagctaagtgagggtcttgggatgacttgctgtgttcctcaagctgcactttggggccatctctgcagtattagccccctttttgcttggtggtactctgtctgtgcctgtgtgtgtgtgtgatagtcactcttgcatggcttccatgtctggtttgtggcatttggggataaggtgctgaagccagagcatttgcagtttgtttgaggcctcgttgccaatgatagatcactcctgttgacctggtatgtctgcttgcttgctgcttttccttgctttctcttggaagaggaaaggactctggtcaggcccaggctgagtgagatgagctgcagctggctcatggccttcttagagcagagagaggagtatgtcattttactaagttcctaaacaaacatttatgcaggcaacactccttgcagatccagaaactgaggcacaatagggttatgacttgctcaagaatatgtagctgctagggggtaaatcaaggcatcacaatttctgttcagcgggcaggaataggctgtgaattgctagcactttttttttttaagcaattactttttgacttgttcctctgaaagtgcaagaggcgtacacctttcccaaatgtagactagaatctgcaggatgccacccactgtatagttctgctttcccagagaggaagaacttttagaaaccaaatgatcttaattgttattgcccacccctggcttttccgggtagaaaattcacagtaggaatgattgttaagagagagtgcttggaaccatgggttaacaggaaaggctacctaacttcacatatctgcaaccagagcagccaccaagcattacttagcagcaggaaaatgattgtatttgagttcctgtgtgtccaaaactgaggcaccatgttctttgaaaacatgccacctcaaggctgggcgcggtggctcacacctgtaatcccagcactttgggaggccgaggcgggcggatcaccggaggtcgggagtttgagaccagcctgaccaacatggagaaaccccatctctactaaaaatacaaaattagccgggcgtggtggcatgcgcctataatctcagctacttgggaggctgaggcaggagaattgcttgaacccaggaggcggaggttgcggtgagttgagatcgtgccattgcactccggcctgggcaacaacagcaaaactccgtctcaaaaaaaaaaaaaaaaaaattgccacctcacagtctctatcgttgggccctgtggttgcaaagctgcctcctgaattaagaaggaaagggaaaagatatagctggaagcgagtggaagagatgctgagggctggggctgcacagacgtgctcagcagggctacaggtgctcaagccctattggggatgggtggggagtggggcagcggcgtttgccaccttaagaattggggccaaagccactgatgtttatttgacagtgacactgcactgggtacttaaagaaattatttcccgttgtaattataattactgcttattaaggaaaatatgggaattttagaaagaatcaagtttgccacccaaatgctaccactgttaatcttttggtgttaaatgttccccctagacatttctgtgcatagatttttggtgtgtttacatagtcgttattctgtatatacaattttatgtcccttttgtacttaacgtataaacattttttccatgttacagtcttaaacagaattttatggctgcagcctcttcgatttgagtttctgtagcatggtttgcctggttcccagagctggagggaggcttgggttgtctcctgttagttctggctcacactgcagcttgctgtaatgctgtgtagacggattgctgggctccctgggactgcctctgactgc

SEQ ID NO: 301189 - DNA, 4514 bp, Homo sapiens
cccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcgccgccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaaaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaattttcgctgcaggtgtcaactctgaaatggtcaagctttatgaccttcgttcttttgataaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttgggggttatgccaacagcaaagctgtcacactggaggcttcatttactccagactctcagtttattatgattggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccacccctttccccagctcccaaccaagagctggttctaggcctgtgttatatgtcatatttagcgtttttatatatgacctttgatttctgttgtttgtattttagcacagtgtatgcaccttcatttaaatacatctgtgtgcatacagatacgcatatatgtgtgtgcgtatgcatatatctctcatctgtagtttccaagagttcagctgaagcagatggagtcctgcagcccaggagacaccctgcatccctgctaatagtgtttgccacaagtattagtgagtcttccttattaatattttcatttcagaagactgaagcaaagctgatagtgtttgctgtttctttggcagctaagtgagggtcttgggatgacttgctgtgttcctcaagctgcactttggggccatctctgcagtattagccccctttttgcttggtggtactctgtctgtgcctgtgtgtgtgtgtgatagtcactcttgcatggcttccatgtctggtttgtggcatttggggataaggtgctgaagccagagcatttgcagtttgtttgaggcctcgttgccaatgatagatcactcctgttgacctggtatgtctgcttgcttgctgcttttccttgctttctcttggaagaggaaaggactctggtcaggcccaggctgagtgagatgagctgcagctggctcatggccttcttagagcagagagaggagtatgtcattttactaagttcctaaacaaacatttatgcaggcaacactccttgcagatccagaaactgaggcacaatagggttatgacttgctcaagaatatgtagctgctagggggtaaatcaaggcatcacaatttctgttcagcgggcaggaataggctgtgaattgctagcactttttttttttaagcaattactttttgacttgttcctctgaaagtgcaagaggcgtacacctttcccaaatgtagactagaatctgcaggatgccacccactgtatagttctgctttcccagagaggaagaacttttagaaaccaaatgatcttaattgttattgcccacccctggcttttccgggtagaaaattcacagtaggaatgattgttaagagagagtgcttggaaccatgggttaacaggaaaggctacctaacttcacatatctgcaaccagagcagccaccaagcattacttagcagcaggaaaatgattgtatttgagttcctgtgtgtccaaaactgaggcaccatgttctttgaaaacatgccacctcaaggctgggcgcggtggctcacacctgtaatcccagcactttgggaggccgaggcgggcggatcaccggaggtcgggagtttgagaccagcctgaccaacatggagaaaccccatctctactaaaaatacaaaattagccgggcgtggtggcatgcgcctataatctcagctacttgggaggctgaggcaggagaattgcttgaacccaggaggcggaggttgcggtgagttgagatcgtgccattgcactccggcctgggcaacaacagcaaaactccgtctcaaaaaaaaaaaaaaaaaaattgccacctcacagtctctatcgttgggccctgtggttgcaaagctgcctcctgaattaagaaggaaagggaaaagatatagctggaagcgagtggaagagatgctgagggctggggctgcacagacgtgctcagcagggctacaggtgctcaagccctattggggatgggtggggagtggggcagcggcgtttgccaccttaagaattggggccaaagccactgatgtttatttgacagtgacactgcactgggtacttaaagaaattatttcccgttgtaattataattactgcttattaaggaaaatatgggaattttagaaagaatcaagtttgccacccaaatgctaccactgttaatcttttggtgttaaatgttccccctagacatttctgtgcatagatttttggtgtgtttacatagtcgttattctgtatatacaattttatgtcccttttgtacttaacgtataaacattttttccatgttacagtcttaaaagaaaacgagacaacgagagatagcaaacgaaaacacccaagcatggatcatacgtaagtgccgcacaaaaaaacaatacaaagagggaacgcagagaaagataagaacaagaaagactgactcagacgcaaagaacagacgccagcccgcaaccatgagacaagcgaaacaacatcacgggaggggggggacgcgccctcaaaaacattaccgccctcgggcggagcgccgaccggagcggcgcaacag

SEQ ID NO: 301190 - DNA, 4588 bp, Homo sapiens
cccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcgccgccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaaaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaattttcgctgcaggtgtcaactctgaaatggtcaagctttatgaccttcgttcttttgataaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttgggggttatgccaacagcaaagctgtcacactggaggcttcatttactccagactctcagtttattatgattggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccacccctttccccagctcccaaccaagagctggttctaggcctgtgttatatgtcatatttagcgtttttatatatgacctttgatttctgttgtttgtattttagcacagtgtatgcaccttcatttaaatacatctgtgtgcatacagatacgcatatatgtgtgtgcgtatgcatatatctctcatctgtagtttccaagagttcagctgaagcagatggagtcctgcagcccaggagacaccctgcatccctgctaatagtgtttgccacaagtattagtgagtcttccttattaatattttcatttcagaagactgaagcaaagctgatagtgtttgctgtttctttggcagctaagtgagggtcttgggatgacttgctgtgttcctcaagctgcactttggggccatctctgcagtattagccccctttttgcttggtggtactctgtctgtgcctgtgtgtgtgtgtgatagtcactcttgcatggcttccatgtctggtttgtggcatttggggataaggtgctgaagccagagcatttgcagtttgtttgaggcctcgttgccaatgatagatcactcctgttgacctggtatgtctgcttgcttgctgcttttccttgctttctcttggaagaggaaaggactctggtcaggcccaggctgagtgagatgagctgcagctggctcatggccttcttagagcagagagaggagtatgtcattttactaagttcctaaacaaacatttatgcaggcaacactccttgcagatccagaaactgaggcacaatagggttatgacttgctcaagaatatgtagctgctagggggtaaatcaaggcatcacaatttctgttcagcgggcaggaataggctgtgaattgctagcactttttttttttaagcaattactttttgacttgttcctctgaaagtgcaagaggcgtacacctttcccaaatgtagactagaatctgcaggatgccacccactgtatagttctgctttcccagagaggaagaacttttagaaaccaaatgatcttaattgttattgcccacccctggcttttccgggtagaaaattcacagtaggaatgattgttaagagagagtgcttggaaccatgggttaacaggaaaggctacctaacttcacatatctgcaaccagagcagccaccaagcattacttagcagcaggaaaatgattgtatttgagttcctgtgtgtccaaaactgaggcaccatgttctttgaaaacatgccacctcaaggctgggcgcggtggctcacacctgtaatcccagcactttgggaggccgaggcgggcggatcaccggaggtcgggagtttgagaccagcctgaccaacatggagaaaccccatctctactaaaaatacaaaattagccgggcgtggtggcatgcgcctataatctcagctacttgggaggctgaggcaggagaattgcttgaacccaggaggcggaggttgcggtgagttgagatcgtgccattgcactccggcctgggcaacaacagcaaaactccgtctcaaaaaaaaaaaaaaaaaaattgccacctcacagtctctatcgttgggccctgtggttgcaaagctgcctcctgaattaagaaggaaagggaaaagatatagctggaagcgagtggaagagatgctgagggctggggctgcacagacgtgctcagcagggctacaggtgctcaagccctattggggatgggtggggagtggggcagcggcgtttgccaccttaagaattggggccaaagccactgatgtttatttgacagtgacactgcactgggtacttaaagaaattatttcccgttgtaattataattactgcttattaaggaaaatatgggaattttagaaagaatcaagtttgccacccaaatgctaccactgttaatcttttggtgttaaatgttccccctagacatttctgtgcatagatttttggtgtgtttacatagtcgttattctgtatatacaattttatgtcccttttgtacttaacgtataaacattttttccatgttacagtcttaaaaaaaaaaaaaaaaaaaaaaaaaaaaaaaaaaaaaaaaaaaactgggcaccccgcgtgggccccgaaagaactctttaaaaaacactctcagaagagagccgcgtggggcccgagggggccacctaagaggggcaaaagagcgttcaccaagagagacaccggggaaaatcaaccgggaagcaagaaagatgctcgcgagaataataaaaaccgagagagagacccccggggagccataagaacgactccaaaaagagccccaaaggaggacaaggggggactaccaggggcgagcaccgagaggcccacaagagacggaaaacc

SEQ ID NO: 301191 - DNA, 4117 bp, Homo sapiens
cccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcgccgccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaaaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaattttcgctgcaggtgtcaactctgaaatggtcaagctttatgaccttcgttcttttgataaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttgggggttatgccaacagcaaagctgtcacactggaggcttcatttactccagactctcagtttattatgattggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccacccctttccccagctcccaaccaagagctggttctaggcctgtgttatatgtcatatttagcgtttttatatatgacctttgatttctgttgtttgtattttagcacagtgtatgcaccttcatttaaatacatctgtgtgcatacagatacgcatatatgtgtgtgcgtatgcatatatctctcatctgtagtttccaagagttcagctgaagcagatggagtcctgcagcccaggagacaccctgcatccctgctaatagtgtttgccacaagtattagtgagtcttccttattaatattttcatttcagaagactgaagcaaagctgatagtgtttgctgtttctttggcagctaagtgagggtcttgggatgacttgctgtgttcctcaagctgcactttggggccatctctgcagtattagccccctttttgcttggtggtactctgtctgtgcctgtgtgtgtgtgtgatagtcactcttgcatggcttccatgtctggtttgtggcatttggggataaggtgctgaagccagagcatttgcagtttgtttgaggcctcgttgccaatgatagatcactcctgttgacctggtatgtctgcttgcttgctgcttttccttgctttctcttggaagaggaaaggactctggtcaggcccaggctgagtgagatgagctgcagctggctcatggccttcttagagcagagagaggagtatgtcattttactaagttcctaaacaaacatttatgcaggcaacactccttgcagatccagaaactgaggcacaatagggttatgacttgctcaagaataaatgtagactagaatctgcaggatgccacccactgtatagttctgctttcccagagaggaagaacttttagaaaccaaatgatcttaattgttattgcccacccctggcttttccgggtagaaaattcacagtaggaatgattgttaagagagagtgcttggaaccatgggttaacaggaaaggctacctaacttcacatatctgcaaccagagcagccaccaagcattacttagcagcaggaaaatgattgtatttgagttcctgtgtgtccaaaactgaggcaccatgttctttgaaaacatgccacctcaaggctgggcgcggtggctcacacctgtaatcccagcactttgggaggccgaggcgggcggatcaccggaggtcgggagtttgagaccagcctgaccaacatggagaaaccccatctctactaaaaatacaaaattagccgggcgtggtggcatgcgcctataatctcagctacttgggaggctgaggcaggagaattgcttgaacccaggaggcggaggttgcggtgagttgagatcgtgccattgcactccggcctgggcaacaacagcaaaactccgtctcaaaaaaaaaaaaaaaaaaattgccacctcacagtctctatcgttgggccctgtggttgcaaagctgcctcctgaattaagaaggaaagggaaaagatatagctggaagcgagtggaagagatgctgagggctggggctgcacagacgtgctcagcagggctacaggtgctcaagccctattggggatgggtggggagtggggcagcggcgtttgccaccttaagaattggggccaaagccactgatgtttatttgacagtgacactgcactgggtacttaaagaaattatttcccgttgtaattataattactgcttattaaggaaaatatgggaattttagaaagaatcaagtttgccacccaaatgctaccactgttaatcttttggtgttaaatgttccccctagacatttctgtgcatagatttttggtgtgtttacatagtcgttattctgtatatacaattttatgtcccttttgtacttaacgtataaacattttttccatgttacagtctt

SEQ ID NO: 301192 - DNA, 5368 bp, Homo sapiens
cccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcgccgccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaaaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaattttcgctgcaggtgtcaactctgaaatggtcaagctttatgaccttcgttcttttgataaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttgggggttatgccaacagcaaagctgtcacactggaggcttcatttactccagactctcagtttattatgattggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccacccctttccccagctcccaaccaagagctggttctaggcctgtgttatatgtcatatttagcgtttttatatatgacctttgatttctgttgtttgtattttagcacagtgtatgcaccttcatttaaatacatctgtgtgcatacagatacgcatatatgtgtgtgcgtatgcatatatctctcatctgtagtttccaagagttcagctgaagcagatggagtcctgcagcccaggagacaccctgcatccctgctaatagtgtttgccacaagtattagtgagtcttccttattaatattttcatttcagaagactgaagcaaagctgatagtgtttgctgtttctttggcagctaagtgagggtcttgggatgacttgctgtgttcctcaagctgcactttggggccatctctgcagtattagccccctttttgcttggtggtactctgtctgtgcctgtgtgtgtgtgtgatagtcactcttgcatggcttccatgtctggtttgtggcatttggggataaggtgctgaagccagagcatttgcagtttgtttgaggcctcgttgccaatgatagatcactcctgttgacctggtatgtctgcttgcttgctgcttttccttgctttctcttggaagaggaaaggactctggtcaggcccaggctgagtgagatgagctgcagctggctcatggccttcttagagcagagagaggagtatgtcattttactaagttcctaaacaaacatttatgcaggcaacactccttgcagatccagaaactgaggcacaatagggttatgacttgctcaagaatatgtagctgctagggggtaaatcaaggcatcacaatttctgttcagcgggcaggaataggctgtgaattgctagcactttttttttttaagcaattactttttgacttgttcctctgaaagtgcaagaggcgtacacctttcccaaatgtagactagaatctgcaggatgccacccactgtatagttctgctttcccagagaggaagaacttttagaaaccaaatgatcttaattgttattgcccacccctggcttttccgggtagaaaattcacagtaggaatgattgttaagagagagtgcttggaaccatgggttaacaggaaaggctacctaacttcacatatctgcaaccagagcagccaccaagcattacttagcagcaggaaaatgattgtatttgagttcctgtgtgtccaaaactgaggcaccatgttctttgaaaacatgccacctcaaggctgggattacaggcgtgagccaccaccgcacccagcctagatcaagcattttattctctagtgtgtctcaagagttttctcttccagatgtgtgaataagagtactcatgaattcaagccacagagtggagcagagatcaaagaaggtaatgtttaattataataaatgtgtttctgtccagattcctctgtatcactcagaggtgtattttgtggctgtggtttatgaaggcttcaggccttaatgaacctgagtgttagatttcctattcttagagtataggttatttatccctgaaccatttcaaataaatgtagaaatccacttgttagtctcatcttctttaacattctttggaaatgtaatttgtgaatacatttctagtaaatttctcaggaaattaatccaaaacagagtcatctttagtatgttaggtaggaaaggttatcaaaagtttaattaggagtgttacactgttattcggtactactttgttagaggcatttgcataggagataagtcttataaataataagatgcacaggttgggctttcacttctccgctgtgtgactgggacattttttttctggacagtttggtgaggaggagggctgtttgaaatagctggaggttcattaactgaaccaagacttactgagcctgctctgtaggtgccaggcactgttatacatagttagggatgaagtcatgaacaaaaaatctccacccacacagagggggaaagaaatgtactattggagttatggggttgaaatttcagtcaaggtgatatttgggtaaagggctaaagttagggagctaccatgccattagcttgggcaacttttcagacagagggaatattaagtgctaagccctcaagcaggaaaatctctgatatattctaagcacagcaaagggaccaatgtggggaggtaagcagggagaggaggaaggtgaggcctgaccaaacaggacccaggctgtgcagggccttgtattctatgcctgactgcagtggaatgagatgggaagccaatcttaagatttacattgtgactatgaacttgggatacagtggcactaagggtataatttatgacaaagttgctaatctggtataatccagaccaaccactcaatctctctcagccttcatttccttttctgtaaaaggataattttcacctcatttacttcataggactattataaagataaaaatgaaatatatgaaagcactataatactggaaattcttagtgataatttttaacaatgacaaactgttttaattgtaacttacttaaattgtgtgtcttttaagttattctgatttccctactgataccacattttgtctccatttctttgctagggtgtgaaacacataaggttgccaacacaagttcttttcacacaactccaaacacatcactgggaatggttcaggcaacgccatccaaagtgcagccatcacccaccgtgcacacaaaagaagcattaggtaaagtattttatctgagtgtgtagcacctgatgacaagttaatgaaagctcttttgcaacctgtttacaattattctttttgttctttaaggtttcatcatgaatatgtttcaggctcctacacttcctgatatttctgatgacaaagatgaatggcaatctctagatcaaaatgaagatgcatttgaagcccagtttcaaagtaataactatttaaaagctactaagtgcatagcattataggtggttatcacagaaaatatcaagaattatttaagaggtgaccctgcccttgattagcttgtcacataaaggcagggaatgcatgaaataaaaataagacagttcttgacaaggtactcaatgtgtgtgatagatttgcttgattaaaggg

SEQ ID NO: 301193 - DNA, 3248 bp, Homo sapiens
cccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcgccgccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaaaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaattttcgctgcaggtgtcaactctgaaatggtcaagctttatgaccttcgttcttttgataaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttgggggttatgccaacagcaaagctgtcacactggaggcttcatttactccagactctcagtttattatgattggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccacccctttccccagctcccaaccaagagctggttctaggcctgtgttatatgtcatatttagcgtttttatatatgacctttgatttctgttgtttgtattttagcacagtgtatgcaccttcatttaaatacatctgtgtgcatacagatacgcatatatgtgtgtgcgtatgcatatatctctcatctgtagtttccaagagttcagctgaagcagatggagtcctgcagcccaggagacaccctgcatccctgctaatagtgtttgccacaagtattagtgagtcttccttattaatattttcatttcagaagactgaagcaaagctgatagtgtttgctgtttctttggcagctaagtgagggtcttgggatgacttgctgtgttcctcaagctgcactttggggccatctctgcagtattagccccctttttgcttggtggtactctgtctgtgcctgtgtgtgtgtgtgatagtcactcttgcatggcttccatgtctggtttgtggcatttggggataaggtgctgaagccagagcatttgcagtttgtttgaggcctcgttgccaatgatagatcactcctgttgacctggtatgtctgcttgcttgctgcttttccttgctttctcttggaagaggaaaggactctggtcaggcccaggctgagtgagatgagctgcagctggctcatggccttcttagagcagagagaggagtatgtcattttactaagttcctaaacaaacatttatgcaggcaacactccttgcagatccagaaactgaggcacaatagggttatgacttgctcaagaatatgtagctgctagggggtaaatcaaggcatcacaatttctgttcagcgggcaggaataggctgtgaattgctagcactttttttttttaagcaattactttttgacttgttcctctgaaagtgcaagaggcgtacacctttcccaaatgtagactagaatctgcaggatgccacccactgccccatcctcccagagcagttaaaactgtctgaacttttcacaacaatgcgtccgcaaatgtggcgt

SEQ ID NO: 301194 - DNA, 3261 bp, Homo sapiens
cccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcgccgccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaaaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaattttcgctgcaggtgtcaactctgaaatggtcaagctttatgaccttcgttcttttgataaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttgggggttatgccaacagcaaagctgtcacactggaggcttcatttactccagactctcagtttattatgattggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccactatagttctgctttcccagagaggaagaacttttagaaaccaaatgatcttaattgttattgcccacccctggcttttccgggtagaaaattcacagtaggaatgattgttaagagagagtgcttggaaccatgggttaacaggaaaggctacctaacttcacatatctgcaaccagagcagccaccaagcattacttagcagcaggaaaatgattgtatttgagttcctgtgtgtccaaaactgaggcaccatgttctttgaaaacatgccacctcaaggctgggcgcggtggctcacacctgtaatcccagcactttgggaggccgaggcgggcggatcaccggaggtcgggagtttgagaccagcctgaccaacatggagaaaccccatctctactaaaaatacaaaattagccgggcgtggtggcatgcgcctataatctcagctacttgggaggctgaggcaggagaattgcttgaacccaggaggcggaggttgcggtgagttgagatcgtgccattgcactccggcctgggcaacaacagcaaaactccgtctcaaaaaaaaaaaaaaaaaaattgccacctcacagtctctatcgttgggccctgtggttgcaaagctgcctcctgaattaagaaggaaagggaaaagatatagctggaagcgagtggaagagatgctgagggctggggctgcacagacgtgctcagcagggctacaggtgctcaagccctattggggatgggtggggagtggggcagcggcgtttgccaccttaagaattggggccaaagccactgatgtttatttgacagtgacactgcactgggtacttaaagaaattatttcccgttgtaattataattactgcttattaaggaaaatatgggaattttagaaagaatcaagtttgccacccaaatgctaccactgttaatcttttggtgttaaatgttccccctagacatttctgtgcatagatttttggtgtgtttacatagtcgttattctgtatatacaattttatgtcccttttgtacttaacgtataaacattttttccatgttacagtctt

SEQ ID NO: 301195 - DNA, 3346 bp, Homo sapiens
cccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcgccgccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaaaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaattttcgctgcaggtgtcaactctgaaatggtcaagctttatgaccttcgttcttttgataaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttgggggttatgccaacagcaaagctgtcacactggaggcttcatttactccagactctcagtttattatgattggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccacccctttccccagctcccaaccaagagctggttctaggcctgtgttatatgtcatatttagcgtttttatatatgacctttgatttctgttgtttgtattttagcacagtgtatgcaccttcatttaaatacatctgtgtgcatacagatacgcatatatgtgtgtgcgtatgcatatatctctcatctgtagtttccaagagttcagctgaagcagatggagtcctgcagcccaggagacaccctgcatccctgctaatagtgtttgccacaagtattagtgagtcttccttattaatattttcatttcagaagactgaagcaaagctgatagtgtttgctgtttctttggcagctaagtgagggtcttgggatgacttgctgtgttcctcaagctgcactttggggccatctctgcagtattagccccctttttgcttggtggtactctgtctgtgcctgtgtgtgtgtgtgatagtcactcttgcatggcttccatgtctggtttgtggcatttggggataaggtgctgaagccagagcatttgcagtttgtttgaggcctcgttgccaatgatagatcactcctgttgacctggtatgtctgcttgcttgctgcttttccttgctttctcttggaagaggaaaggactctggtcaggcccaggctgagtgagatgagctgcagctggctcatggccttcttagagcagagagaggagtatgtcattttactaagttcctaaacaaacatttatgcaggcaacactccttgcagatccagaaactgaggcacaatagggttatgacttgctcaagaatccctattggggatgggtggggagtggggcagcggcgtttgccaccttaagaattggggccaaagccactgatgtttatttgacagtgacactgcactgggtacttaaagaaattatttcccgttgtaattataattactgcttattaaggaaaatatgggaattttagaaagaatcaagtttgccacccaaatgctaccactgttaatcttttggtgttaaatgttccccctagacatttctgtgcatagatttttggtgtgtttacatagtcgttattctgtatatacaattttatgtcccttttgtacttaacgtataaacattttttccatgttacagtctt

SEQ ID NO: 301196 - DNA, 3034 bp, Homo sapiens
cccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcgccgccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaaaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaattttcgctgcaggtgtcaactctgaaatggtcaagctttatgaccttcgttcttttgataaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttgggggttatgccaacagcaaagctgtcacactggaggcttcatttactccagactctcagtttattatgattggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccacccctttccccagctcccaaccaagagctggttctaggcctgtgttatatgtcatatttagcgtttttatatatgacctttgatttctgttgtttgtattttagcacagtgtatgcaccttcatttaaatacatctgtgtgcatacagatacgcatatatgtgtgtgcgtatgcatatatctctcatctgtagtttccaagagttcagctgaagcagatggagtcctgcagcccaggagacaccctgcatccctgctaatagtgtttgccacaagtattagtgagtcttccttattaatattttcatttcagaagactgaacaaaactccgtctcaaaaaaaaaaaaaaaaaaattgccacctcacagtctctatcgttgggccctgtggttgcaaagctgcctcctgaattaagaaggaaagggaaaagatatagctggaagcgagtggaagagatgctgagggctggggctgcacagacgtgctcagcagggctacaggtgctcaagccctattggggatgggtggggagtggggcagcggcgtttgccaccttaagaattggggccaaagccactgatgtttatttgacagtgacactgcactgggtacttaaagaaattatttcccgttgtaattataattactgcttattaaggaaaatatgggaattttagaaagaatcaagtttgccacccaaatgctaccactgttaatcttttggtgttaaatgttccccctagacatttctgtgcatagatttttggtgtgtttacatagtcgttattctgtatatacaattttatgtcccttttgtacttaacgtataaacattttttccatgttacagtctt

SEQ ID NO: 301197 - DNA, 928 bp, Homo sapiens
aaaactccgtctcaaaaaaaaaaaaaaaaaaaatgccacctcacggtctctatcgttgggccctgtatttgagttcctgtgtgtccaaaactgaggcaccatgttctttgaaaacatgccacctcaaggctgggcgcggtggctcacacctgtaatcccagcactttgggaggccgaggcgggcggatcaccggaggtcgggagtttgagaccagcctgaccaacatggagaaaccccatctctactaaaaatacaaaattagccgggcgtggtggcatgcgcctataatctcagctacttgggaggctgaggcaggagaattgcttgaacccaggaggcggaggttgcggtgagttgagatcgtgccattgcactccggcctgggcaacaacagcaaaactccgtctcaaaaaaaaaaaaaaaaaaattgccacctcacagtctctatcgttgggccctgtggttgcaaagctgcctcctgaattaagaaggaaagggaaaagatatagctggaagcgagtggaagagatgctgagggctggggctgcacagacgtgctcagcagggctacaggtgctcaagccctattggggatgggtggggagtggggcagcggcgtttgccaccttaagaattggggccaaagccactgatgtttatttgacagtgacactgcactgggtacttaaagaaattatttcccgttgtaattataattactgcttattaaggaaaatatgggaattttagaaagaatcaagtttgccacccaaatgctaccactgttaatcttttggtgttaaatgttccccctagacatttctgtgcatagatttttggtgtgtttacatagtcgttattctgtatatacaattttatgtcccttttgtacttaacgtataaacattttttccatgttacagtctt

SEQ ID NO: 301198 - DNA, 2365 bp, Homo sapiens
cccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcgccgccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaaaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaattttcgctgcaggtgtcaactctgaaatggtcaagctttatgaccttcgttcttttgataaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttgggggttatgccaacagcaaagctgtcacactggaggcttcatttactccagactctcagtttattatgattggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtagtgacactgcactgggtacttaaagaaattatttcccgttgtaattataattactgcttattaaggaaaatatgggaattttagaaagaatcaagtttgccacccaaatgctaccactgttaatcttttggtgttaaatgttccccctagacatttctgtgcatagatttttggtgtgtttacatagtcgttattctgtatatacaattttatgtcccttttgtacttaacgtataaacattttttccatgttacagtctt

SEQ ID NO: 301199 - DNA, 2136 bp, Homo sapiens
cccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcgccgccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaaaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaattttcgctgcaggtgtcaactctgaaatggtcaagctttatgaccttcgttcttttgataaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttgggggttatgccaacagcaaagctgtcacactggaggcttcatttactccagactctcagtttattatgattggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtatgtattaagctgcttgggggtcctctagatat

SEQ ID NO: 301200 - DNA, 2139 bp, Homo sapiens
cccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcgccgccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaaaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaattttcgctgcaggtgtcaactctgaaatggtcaagctttatgaccttcgttcttttgataaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttgggggttatgccaacagcaaagctgtcacactggaggcttcatttactccagactctcagtttattatgattggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtactgtgagtcaattaaacgtgtttactttataaatt

SEQ ID NO: 301201 - DNA, 1369 bp, Homo sapiens
cccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcgccgccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaaaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccagggcctcatgcatctgcaggggaagccagtttgttcttttgatccagaagggttaattttcgctgcaggtgtcaactctgaaatggtcaagctttatgaccttcgttcttttgataaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttgggagatgctgagggctggggctgcacagacgtgctcagcagggctacaggtgctcaagccctattggggatgggtggggagtggggcagcggcgtttgccaccttaagaattggggccaaagccactgatgtttatttgacagtgacactgcactgggtacttaaagaaattatttcccgttgtaattataattactgcttattaaggaaaatatgggaattttagaaagaatcaagtttgccacccaaatgctaccactgttaatcttttggtgttaaatgttccccctagacatttctgtgcatagatttttggtgtgtttacatagtcgttattctgtatatacaattttatgtcccttttgtacttaacgtataaacattttttccatgttacagtctt

SEQ ID NO: 301202 - DNA, 898 bp, Homo sapiens
cccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcgccgccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaaaccaaagagaaccctgtacagtaagaaatatggtgtggacctcatcagatacactcatgcagcaaacacagttgtttacagctctaacaaaatagacgatactattcgttacttgtccttgcatgacaacaaatacatcagatactttcctggacatagcaaaagggtggtggccttgtccatgtcacctgtggatgacactttcatttctgggtctcttgataagaccattcgactctgggatctccggtctcctaactgccaggtaatggtacctcacagttatactttttgagcattttctttggtaggcactgtaatgaactctacctctcaaagaagggagaaaacagtggttccattctgggatcacagggtctttttaaactttggagaaaatctgtttttttagttggtagctgctaagcacataccctaatctagtgcagattgcattgtactctgtgg

SEQ ID NO: 301203 - DNA, 335 bp, Homo sapiens
agtcagggttttaccatgttggccaggctagtctcaaaacccgacctcaaatgatccacccgcctcagcctcccaaagtgctgggattacaagcgtgagccaccacgtgagccaggggaagtttttaaatttaccactttttaacaattccatttaggaaagttcagttgagctgttggacttggacaactttgtacctctcatctttgtccttgtcatctagtcattacctcctaagcagggacatcatgggtgtcatgaagcattcatgtgtgatggcatttctttgcttctcatttcttcatgtgtttgacatttctcctagctccaaactg

SEQ ID NO: 301204 - DNA, 2426 bp, Homo sapiens
  misc_feature (3)..(3): n is a, c, g, or t
  misc_feature (1922)..(1922): n is a, c, g, or t
  misc_feature (1936)..(1936): n is a, c, g, or t
ggngtctcgagcatgtatctctagcatgttggcctatgggctgggacttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcaggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttattaaaaaaaaaaaaaaaaaaaaaaaaaaaaaaaaaaaaaaaaaaaaaacaaaaaanaaaaaaaaaaaaanaaaaaaaaaaagtcgctattcccaacataaaaaaacttgtcaaacattcaacattattctcagctttctgtatttctaaaaaggccggcactcgcacgccttttccaacatttttccaatcgtgcctggcaatctcaaacttgtttgcgcaaatcattgctaacaggtcacctaatttactgttaaatcaggtaattctctacccaaagggtcgacaaaggcaaatcccgcttttaatccttttaaccgagatacgtacttttgacattccaatttgtaaccatagtcccttattttagaacgtgttctccaacatcctttgtgggcacatcctcttttaaggcataggctccttttgctggaatgatccctcttattccaagtatatgggctctcttgtccgttcaatctgtcaattcgttcctttggaacccctctttaatagcttgcgccctataaggccttgctctgccctgtctttcggtctcct

SEQ ID NO: 301205 - DNA, 1927 bp, Homo sapiens
  misc_feature (3)..(3): n is a, c, g, or t
ggngtctcgagcatgtatctctagcatgttggcctatgggctgggacttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcaggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttattaaaaaaaaaacgtacttgtacagccctttatattccttatccccgtgtgtacaagaaca

SEQ ID NO: 301206 - DNA, 2409 bp, Homo sapiens
  misc_feature (3)..(3): n is a, c, g, or t
  misc_feature (1899)..(1899): n is a, c, g, or t
ggngtctcgagcatgtatctctagcatgttggcctatgggctgggacttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcaggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttattaaaaaaaaaaaaaaaaaaaaaaaaaaaaaanaaaaaaaaaaaaaaaaaaataaaaaaaaaaaaaaaaacaaaaaataaaaaaaaaaacaaaaaaataaacataaaaaaaaaaactaaaaaaaaaaatgaaaaaaaaaatctcttcggggcgggggaatttaaaccgttatatttgattacgccccaaaaaggggggcccccttaacccccttttttttttattaccccccgttaattaaagggggggggttcctgaaaaacccaaaaaaaagggggggtccaccccttaaaaaaaagttcaaaaaaaaaaaaaaaaccccccgcgggagaactacctttcctaacaaaccttcaccaggggccctcttaacgaacctctggaaaatttaggggcgaatgtcacctgatttcttcacaacccttgttgtgtagtgaccccccttaaaattggaaacacaccattttacccttttttggagcaaaaatattacacaagggactttttttcaaaaaataataaaaaaaagttgcccccgcggcc

SEQ ID NO: 301207 - DNA, 2186 bp, Homo sapiens
  misc_feature (3)..(3): n is a, c, g, or t
ggngtctcgagcatgtatctctagcatgttggcctatgggctgggacttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcaggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttattaaaaaaaaaaaaaaaaaactcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggta

SEQ ID NO: 301208 - DNA, 2182 bp, Homo sapiens
  misc_feature (3)..(3): n is a, c, g, or t
  misc_feature (1877)..(1877): n is a, c, g, or t
  misc_feature (1891)..(1891): n is a, c, g, or t
  misc_feature (1931)..(1931): n is a, c, g, or t
ggngtctcgagcatgtatctctagcatgttggcctatgggctgggacttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcaggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttattaaaaaaaanaaaaaaaaaaaaanaaaaaaaaaaaaaaaaaaaaaaaaaaaaaaaaaaaaaaanaaaaaaaaaaaaaaaacctcggggccaccgttttcaaaaacctgaatttcaaattcgccccaaaagggggaaacccttaattcccttttttttccttttaacctgggttaatcccaggggggtttttcgccaaaatccccccaaaattggggttcctaatggtttaaaaatttgggaaaaaaaaatttcaaaaccttgggggtaaatgcctttggcaaagatttttaacaggggccctttgaaaaaccttg

SEQ ID NO: 301209 - DNA, 2372 bp, Homo sapiens
  misc_feature (3)..(3): n is a, c, g, or t
  misc_feature (1868)..(1868): n is a, c, g, or t
  misc_feature (1882)..(1882): n is a, c, g, or t
ggngtctcgagcatgtatctctagcatgttggcctatgggctgggacttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcaggaccctccccagaccgcctgggccgcccggatgtgcactcgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttattaaaaaaaaaaaaaaaaaaaaaaaaaaaaaaaaaaaaaaaaaaaaaacaaaaaanaaaaaaaaaaaaanaaaaaaaaaaagtcgctattcccaacataaaaaaacttgtcaaacattcaacattattctcagctttctgtatttctaaaaaggccggcactcgcacgccttttccaacatttttccaatcgtgcctggcaatctcaaacttgtttgcgcaaatcattgctaacaggtcacctaatttactgttaaatcaggtaattctctacccaaagggtcgacaaaggcaaatcccgcttttaatccttttaaccgagatacgtacttttgacattccaatttgtaaccatagtcccttattttagaacgtgttctccaacatcctttgtgggcacatcctcttttaaggcataggctccttttgctggaatgatccctcttattccaagtatatgggctctcttgtccgttcaatctgtcaattcgttcctttggaacccctctttaatagcttgcgccctataaggccttgctctgccctgtctttcggtctcct

SEQ ID NO: 301210 - DNA, 2293 bp, Homo sapiens
  misc_feature (3)..(3): n is a, c, g, or t
  misc_feature (1783)..(1783): n is a, c, g, or t
ggngtctcgagcatgtatctctagcatgttggcctatgggctgggacttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcaggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctgccctcctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttattaaaaaaaaaaaaaaaaaaaaaaaaaaaaaanaaaaaaaaaaaaaaaaaaataaaaaaaaaaaaaaaaacaaaaaataaaaaaaaaaacaaaaaaataaacataaaaaaaaaaactaaaaaaaaaaatgaaaaaaaaaatctcttcggggcgggggaatttaaaccgttatatttgattacgccccaaaaaggggggcccccttaacccccttttttttttattaccccccgttaattaaagggggggggttcctgaaaaacccaaaaaaaagggggggtccaccccttaaaaaaaagttcaaaaaaaaaaaaaaaaccccccgcgggagaactacctttcctaacaaaccttcaccaggggccctcttaacgaacctctggaaaatttaggggcgaatgtcacctgatttcttcacaacccttgttgtgtagtgaccccccttaaaattggaaacacaccattttacccttttttggagcaaaaatattacacaagggactttttttcaaaaaataataaaaaaaagttgcccccgcggcc

SEQ ID NO: 301211 - DNA, 1913 bp, Homo sapiens
  misc_feature (3)..(3): n is a, c, g, or t
ggngtctcgagcatgtatctctagcatgttggcctatgggctgggacttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcaggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggcaccggttttccttctgtttctgtcgtcttgtgctctttttcctgcgctttcctctcttttctagtcacccccttcttcttatcttatcctttggacatcactttccttctctttcctgtctttatatctctgctactctatgtcgctctgtagactctctctttctctgtactttcctgtcttatacggtctccattgtctatgctcctctactctctgcattctccatctcttgtttctcttgtctctctctcaaacccc

SEQ ID NO: 301212 - DNA, 1880 bp, Homo sapiens
  misc_feature (3)..(3): n is a, c, g, or t
  misc_feature (1655)..(1655): n is a, c, g, or t
  misc_feature (1670)..(1670): n is a, c, g, or t
ggngtctcgagcatgtatctctagcatgttggcctatgggctgggacttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcaggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggctgnaacaatccacacaanactatcccccacacctaatactctaaccccctattacattaagaaactacccctatcccctacccttccctgtttacacctgtctaactgaaaaaaacacacacttagtctcttaaaaacttatttgaacaccggtttgtatcgatatccctttaccctttctattaaacctatgcaatttctaaaatatactttgtcgttctttaaaat

SEQ ID NO: 301213 - DNA, 1787 bp, Homo sapiens
  misc_feature (3)..(3): n is a, c, g, or t
ggngtctcgagcatgtatctctagcatgttggcctatgggctgggacttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcaggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggccgcccgcacgccctccgtgaccgagactatatgccctcggcttcccagggacgtgacccatctcgcatcgtgcccctgtctctgtgcataggactgtgctacagtaccctgccccttagcctctatcggcctctt

SEQ ID NO: 301214 - DNA, 1793 bp, Homo sapiens
  misc_feature (3)..(3): n is a, c, g, or t
ggngtctcgagcatgtatctctagcatgttggcctatgggctgggacttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcaggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggctatacttatttgtgtataagattataattattttatatttcattttataattatattataattttattattataattaactgttattattctaataatattactatctaatttaattatttttttattttctttaatcttt

SEQ ID NO: 301215 - DNA, 2083 bp, Homo sapiens
  misc_feature (3)..(3): n is a, c, g, or t
  misc_feature (1579)..(1579): n is a, c, g, or t
  misc_feature (1593)..(1593): n is a, c, g, or t
ggngtctcgagcatgtatctctagcatgttggcctatgggctgggacttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcaggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccgtaaaaaaaaaattggttctttattaaaaaaaaaaaaaaaaaaaaaaaaaaaaaaaaaaaaaaaaaaaaaacaaaaaanaaaaaaaaaaaaanaaaaaaaaaaagtcgctattcccaacataaaaaaacttgtcaaacattcaacattattctcagctttctgtatttctaaaaaggccggcactcgcacgccttttccaacatttttccaatcgtgcctggcaatctcaaacttgtttgcgcaaatcattgctaacaggtcacctaatttactgttaaatcaggtaattctctacccaaagggtcgacaaaggcaaatcccgcttttaatccttttaaccgagatacgtacttttgacattccaatttgtaaccatagtcccttattttagaacgtgttctccaacatcctttgtgggcacatcctcttttaaggcataggctccttttgctggaatgatccctcttattccaagtatatgggctctcttgtccgttcaatctgtcaattcgttcctttggaacccctctttaatagcttgcgccctataaggccttgctctgccctgtctttcggtctcct

SEQ ID NO: 301216 - DNA, 1649 bp, Homo sapiens
  misc_feature (3)..(3): n is a, c, g, or t
ggngtctcgagcatgtatctctagcatgttggcctatgggctgggacttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcaggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctgcgccatcgtggctacgaagcgcacggatggcgcgtctccttatgagcggacgcagtgattataggcttacggctctaagattaaaaatgccctagcccatttcctaccacaaggcacacttacacccattatccccatactagttattatcgaaaccatcagcctactcattcaaccaatagccctggccgtacgcttaaccgctaacattactgcaggccaactactcatgcacctaattggacgcgccatcgtgcgctgag

SEQ ID NO: 301217 - DNA, 1282 bp, Homo sapiens
  misc_feature (778)..(778): n is a, c, g, or t
  misc_feature (792)..(792): n is a, c, g, or t
ggaaacaaggctatgaaccatgattagcgaaggtcgagactcgggaaccctggggttgtgggcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttattaaaaaaaaaaaaaaaaaaaaaaaaaaaaaaaaaaaaaaaaaaaaaacaaaaaanaaaaaaaaaaaaanaaaaaaaaaaagtcgctattcccaacataaaaaaacttgtcaaacattcaacattattctcagctttctgtatttctaaaaaggccggcactcgcacgccttttccaacatttttccaatcgtgcctggcaatctcaaacttgtttgcgcaaatcattgctaacaggtcacctaatttactgttaaatcaggtaattctctacccaaagggtcgacaaaggcaaatcccgcttttaatccttttaaccgagatacgtacttttgacattccaatttgtaaccatagtcccttattttagaacgtgttctccaacatcctttgtgggcacatcctcttttaaggcataggctccttttgctggaatgatccctcttattccaagtatatgggctctcttgtccgttcaatctgtcaattcgttcctttggaacccctctttaatagcttgcgccctataaggccttgctctgccctgtctttcggtctcct

SEQ ID NO: 301218 - DNA, 1068 bp, Homo sapiens
  misc_feature (3)..(3): n is a, c, g, or t
ggngtctcgagcatgtatctctagcatgttggcctatgggctgggacttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcaggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggccggggcatgggttggcggggctccacttcaggggacggaaggcggaggcaaacggagccaccccgtgacc

SEQ ID NO: 301219 - DNA, 1251 bp, Homo sapiens
  misc_feature (3)..(3): n is a, c, g, or t
  misc_feature (747)..(747): n is a, c, g, or t
  misc_feature (761)..(761): n is a, c, g, or t
ggngtctcgagcatgtatctctagcatgttggcctatgggctgggacttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcaggaccctccccagaccgcctgggccgcccggatgtgcactaaaatggaacagcccttctaccacgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttattaaaaaaaaaaaaaaaaaaaaaaaaaaaaaaaaaaaaaaaaaaaaaacaaaaaanaaaaaaaaaaaaanaaaaaaaaaaagtcgctattcccaacataaaaaaacttgtcaaacattcaacattattctcagctttctgtatttctaaaaaggccggcactcgcacgccttttccaacatttttccaatcgtgcctggcaatctcaaacttgtttgcgcaaatcattgctaacaggtcacctaatttactgttaaatcaggtaattctctacccaaagggtcgacaaaggcaaatcccgcttttaatccttttaaccgagatacgtacttttgacattccaatttgtaaccatagtcccttattttagaacgtgttctccaacatcctttgtgggcacatcctcttttaaggcataggctccttttgctggaatgatccctcttattccaagtatatgggctctcttgtccgttcaatctgtcaattcgttcctttggaacccctctttaatagcttgcgccctataaggccttgctctgccctgtctttcggtctcct

SEQ ID NO: 301220 - DNA, 1282 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301221 - DNA, 5048 bp, Homo sapiens
  misc_feature (2242)..(2242): n is a, c, g, or t
  misc_feature (2924)..(2924): n is a, c, g, or t
cagacactgcagagggtgatgtgtggaatctaccacgtgcgccatgctgcctttctaaaggccaaacagttttaaaatctagcctgaaggtttcagatcagggatttcggcctgtatatcaagagttagagttggccgggcacggtggctcacacctgtaatcccagcactttgggaggccgaggcgggcagattgtttgagcctcaggagttggagaacagcttgggcaatgtggcaaaagtctgtctctacaaaaaatacaaaaattaggcaggcgtggtgttacacgcctgtagtcccaactactcgggaggctgaggtgggaggattgcttgaacccaggaggcagaggctgcagtgaaccgagatcatgtcactgtactccagtctgggcgacacagcaagaccctgtctccaaaaaaaaaaaaaaaaaagttgggggaagcattccatgtgcagatggagggactggcccgagtcaaggtgggaggcgtgcaaacgcaggctctcacagtgcgtggccagcagcgtgggccccggcacggggcatggagcagagtagacagtgctgagtcctgctcactgtcctgtctggggagtcatcacatctactggaggtggctcagggcaggctccatctcttgcccagggcagcagggtgggccctgtggctgtactctttgttgctgccctaaagtgccaagagaacttgttttggaatcataaatcctgagtttgcagcctgttgctctcaactcttccctggttgtgtgacctcaggcaagtcaccctttctggtttgttttcccatctgcaaaacaggatgagagccagtaaggccccttcccgccctcaagttctatgtctctggtggctttaaaggtggagtcgtttctgctgctcatctgcagtgccgagtggcagtgcctcatcccactctcagtccgtgacctggagggtgggtttataccttggaccacagtcagaggtgccgggttctcagcggcccccatcttggtccaaggctgggcctctcacctgcccctctctctcccctcagtggtggctggacctcgtggaagcccctctggctgtgtggctatggactcacgcagagcactgtcggcatcatcgggctggggcgcataggtgaggctcccaccggcccgcttgcccgccccggctctcacagcgtggtttgcatccctggcaccacgtgtctgaaggctgagaagacccacatgctgtcagggcactttgcttgcagtagagatatctctaatgagggatacagctttgtaaaacacaggcaaatacataaataaaccaaagcaggattccttaagaactcaccaggtgataaaagcaagttgcctaagggtcagggggcttcatgattccggctccataaagaacagatgaagactacaaatgtgttggggccgttaggagtggttaccgtgagagagcccattcccccgacacctactccggcttgcgttctggaaggtatgtgactcacaaagccctaactcgggccggagggctcagtgggcagagttgatctgcagttctgcagatgaggcagagacacttttcttccagtggcccttatttggagaagcctggcagaagggcgtgagcctagccaagcagctatctattggtggttctctgtcatcctgcctggtgcaggggtgcgggtgagggtggagagtgtggagaacctgtctagccaacgaacagccctgcctctcactagagagttgcttggaggaacccaacagctttggggcacgttctgagcctgaaaatccaactgtacaaatctgtctcagcagcagcttacatgaaaattgtaagtttggggtgagctggcagtttggcagtgccaccaaaaagtcaaatggggtctgagactgcattcacagaagcagagggtccaggacaaaggaggggactgcttgaccaggtgtctcctttgtgaaaacctctccagttctcagaggttaggaaaaacctgagtggctttccagatggcttggaccatgtgaggacagcatcagccagtcacagtctcaggggagctgaggtgctgtctccagatccctggggcagtgtgggctggctgggggctagttacagtggggcagccagccccccacccgctttggaggagacaggagcaggcaactcgggctgtgctgatgaaaagggtctgccctgagggccgctgttccngaaatgctgggtggtgtccctaccctttgcgggactgggaacgagacatggactctccttgctctaggccaggccattgctcggcgtctgaaaccattcggtgtccagagatttctgtacacagggcgccagcccaggcctgaggaagcagcggaattccaggcagagtttggtaagtgaagccttgatttccacaggagcctatctgtgcccagttgagaggctgtattttctctcaatggtggcattttcaggcagagggcaggagctccaggcatgtccaggggctgctgtctggtagatgtttaatctacctgcccctggacactggcccactcagggagcacagggacttacccaggtcctctccgagccagcagagcagtccagggctcccgtctttcagagtcctttgttaccattccccattgtgggcggagcagcggggatggtggtgggtgtgaggaagggctgggcactttcactgtcttttccttcataaactggcaagcactaccctagcctttgtgtgcgccccttagtccaggcggatccagcacctggcgggtccacagcctggtgagcagatggcaggctggatctcaagcattccccacgcccctgggcactttgggccctgaaggtagttaaagccagagtggtccagatcccactgtgtgtnatttgactttgtgcactcatgagagttgtccaggtagagactcggccttcaggaagcatcttgggagtttctgttagggagtcgggagcaaggggctggtctcccgccatctggttgtccctagcctgggactcagtgcctgatggagtcctgccctccctcagtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggtatcctagggccaccttacccagcaagcctggagaggagccatccccactgctgccatctggagattttcttccccgtgggttgttggtgagaccccaggctgagcttgctggtttccataaaccaaacaaccaactcagaaattcgtgggaatacacgagacctccgtacagggaagaagagccgtcagagtgggcctggcctgtctgcttctcagcagtggcccccacccggcggggcctggcacacagcagcgtggcttcagggagtgttcccagggagcctctgcaggcccattatcctccaccacaaagggctggacttgaggatctgaagggccctctggaggccgcctcccacactgctgagcctggctttgtctggctgtggttcagtgatactttgaaccttatgctcctgggcggacagaccctaaaactcacgtggtcgtagctcctcacactgtccctaggggtgccttcaggccactgggcatgtatggaggtcagaccttccttctctgccactccaagcccttcctagctggtgccccttgagcctgtttacatcagtttaggggaagggggattgggtgaggtcatcctgaggactcgtccaccccaaaggtacctgtaattaccaacatttagctacaaaacaggtgacctgggaatggaagagtgaaacatgcaggaccacagggctcgcactgctggctggcagcagtcacagctgccgtgtactgggtgcctgcgtgtacccaggacagcccaggaccgtgtattactcattagtgcacaagtattacttagtgcacaatatacagtctctagaagatgacttcttgccttcagtcgccgctccctttgatggctgtggttaggggtgtgctcgttcctctgccctggtttagacaggtacctgatagcacactgtggtgcttctcagtgggggtctgggggtcaaccagatcagaaacacttggatggggcctaacacagatgcccttctgggccctgttcatgcagtagagcatgtaagaaagctttaatcctcccaacatgcctgggagttaggtggtattctccttatctcacagagtagataatttgagacacagataattcgaggcacagagaatttgagacacttgcccaaggtcacacagctagaaggaggcagggctggagttctctgagtatataagacttacagacatactgtaagtatacctaagacttactgctttaaaagtcagtgccaagtgagtggaaaaattcattctgtaggttgttctgcctcaaaggtggcctgggcggagggatcttcggggtacccatgtcaccactgtcattcccaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301222 - DNA, 408 bp, Homo sapiens
agccatgaaaacagcccagctgaaggctgctgaaccacccttcttatctccctctctctctctctctcctttccagtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301223 - DNA, 1254 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgaggctgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301224 - DNA, 1707 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaaaaaaaaaaaaaaaaaaaaaaaaaaaaaaaaaaaaaaaaaaaaaaaaaaaaaaaaaaaaaaaaaaaaaaaaaaaaaaacctgtgtgcgcggcgcgcccgccgcgcgcgccccgaaaaaacttaaaacaccaccgggggggcggcgcgggccaccacaggacgagaacagaagagaacgaggggcataacacgaggtgcttccaagagagaacatctgggaggcacaacaagacagggggaggggtgactctctccacaaagagaataaaaaaagcgcggcgggtgagacaacaacgacgagggtagtaagaaaaaaacaacaaacagagggggtcttcggagggaggaactcaacggggggggttactaccacagcgaggggcccacaagagagggggcgcaaaacaagaaaggccgccgccgggg

SEQ ID NO: 301225 - DNA, 1707 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaaaaaaaaaaaaaaaaaaaaaaaaaaaaaaaaaaaaaaaaaaaaaaaaaaaaaaaaaaaaaaaaaaaaaaaaaaaaatttgggggcccccccccccccaaaaaatttagaaaagaccacaagggtgggggggcgagcacgcgcgcggccccacgaaatagagagaaaaacagcgcggacgcaaaagcgggggtctcccaaagaagagaccaacctgggtggcaaaagaaacggggggcggtgaagaaggcccacaaccacaaagaaaaaaacagccccgccgcggggagaaaaaacagggcgggctgttgcagaagaaacaaacctgcagggagggtctaccgaaggagctacaaaggcggtggtcctcactacaggggagcggcccaacagaggcccaaaataaaaaagcgccccggggagcgagt

SEQ ID NO: 301226 - DNA, 1313 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaaacccgctcctcccatctcccccacaaagggg

SEQ ID NO: 301227 - DNA, 1123 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301228 - DNA, 1023 bp, Homo sapiens
tgggggctgatctagcaggatcctttctggatgcaagtgtgggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301229 - DNA, 1303 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgagcttcgatgccataggagtgggcagcatgtgcgcctcaacgatgctggtcatttccatctatgtccataatgtctgtgagagcctgaagttacag

SEQ ID NO: 301230 - DNA, 1798 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgaggctgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcggtaactgcagcttgggatctggagggggcctagagagaggggtggctatgagagaaagaagagctgttgatttgtttttactgcatatccctcggccattcagggagaatgtgaggtggctgatgatagaatctgtccacatgtgcacaggtcagttacaataaaccccagcagtcagaaacagtgggtaacttctgtgtaggtggcaccctttcacattcattatcttttttgatccccacaacaataccttgaagtagcaaaggcaggtgttattctttctgtttcagatgaggaaattcagaaaggttaagttacttgttcagtccctgaaccctgatcttccatcttcatatccttccaaagtgggagataatctaaataggaatgaggactgcccgtttttgagtgctcatttatagttctgagcttcctggcaggcagatcaaagagggagcaaagtaactccatggaaatgtcccagcagtagacattggtaaatatggttgaggctgatgttaccacccagatgtctgattcgtagtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301231 - DNA, 1213 bp, Homo sapiens
  misc_feature (1195)..(1195): n is a, c, g, or t
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaaccgaagctcccaccccctccccccccccccncccccacccacccccccc

SEQ ID NO: 301232 - DNA, 2441 bp, Homo sapiens
  misc_feature (1670)..(1670): n is a, c, g, or t
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggtgaggctcccaccggcccgcttgcccgccccggctctcacagcgtggtttgcatccctggcaccacgtgtctgaaggctgagaagacccacatgctgtcagggcactttgcttgcagtagagatatctctaatgagggatacagctttgtaaaacacaggcaaatacataaataaaccaaagcaggattccttaagaactcaccaggtgataaaagcaagttgcctaagggtcagggggcttcatgattccggctccataaagaacagatgaagactacaaatgtgttggggccgttaggagtggttaccgtgagagagcccattcccccgacacctactccggcttgcgttctggaaggtatgtgactcacaaagccctaactcgggccggagggctcagtgggcagagttgatctgcagttctgcagatgaggcagagacacttttcttccagtggcccttatttggagaagcctggcagaagggcgtgagcctagccaagcagctatctattggtggttctctgtcatcctgcctggtgcaggggtgcgggtgagggtggagagtgtggagaacctgtctagccaacgaacagccctgcctctcactagagagttgcttggaggaacccaacagctttggggcacgttctgagcctgaaaatccaactgtacaaatctgtctcagcagcagcttacatgaaaattgtaagtttggggtgagctggcagtttggcagtgccaccaaaaagtcaaatggggtctgagactgcattcacagaagcagagggtccaggacaaaggaggggactgcttgaccaggtgtctcctttgtgaaaacctctccagttctcagaggttaggaaaaacctgagtggctttccagatggcttggaccatgtgaggacagcatcagccagtcacagtctcaggggagctgaggtgctgtctccagatccctggggcagtgtgggctggctgggggctagttacagtggggcagccagccccccacccgctttggaggagacaggagcaggcaactcgggctgtgctgatgaaaagggtctgccctgagggccgctgttccngaaatgctgggtggtgtccctaccctttgcgggactgggaacgagacatggactctccttgctctaggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301233 - DNA, 2413 bp, Homo sapiens
  misc_feature (1642)..(1642): n is a, c, g, or t
actccagcctggccccgccccggcccagctacattcccgggccagcttctgtactgccaggtccgggtcggcggctgcactgcggatgagaccggtgcgactcatgaaggtgttcgtcacccgcaggatacccgccgaggctgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggtgaggctcccaccggcccgcttgcccgccccggctctcacagcgtggtttgcatccctggcaccacgtgtctgaaggctgagaagacccacatgctgtcagggcactttgcttgcagtagagatatctctaatgagggatacagctttgtaaaacacaggcaaatacataaataaaccaaagcaggattccttaagaactcaccaggtgataaaagcaagttgcctaagggtcagggggcttcatgattccggctccataaagaacagatgaagactacaaatgtgttggggccgttaggagtggttaccgtgagagagcccattcccccgacacctactccggcttgcgttctggaaggtatgtgactcacaaagccctaactcgggccggagggctcagtgggcagagttgatctgcagttctgcagatgaggcagagacacttttcttccagtggcccttatttggagaagcctggcagaagggcgtgagcctagccaagcagctatctattggtggttctctgtcatcctgcctggtgcaggggtgcgggtgagggtggagagtgtggagaacctgtctagccaacgaacagccctgcctctcactagagagttgcttggaggaacccaacagctttggggcacgttctgagcctgaaaatccaactgtacaaatctgtctcagcagcagcttacatgaaaattgtaagtttggggtgagctggcagtttggcagtgccaccaaaaagtcaaatggggtctgagactgcattcacagaagcagagggtccaggacaaaggaggggactgcttgaccaggtgtctcctttgtgaaaacctctccagttctcagaggttaggaaaaacctgagtggctttccagatggcttggaccatgtgaggacagcatcagccagtcacagtctcaggggagctgaggtgctgtctccagatccctggggcagtgtgggctggctgggggctagttacagtggggcagccagccccccacccgctttggaggagacaggagcaggcaactcgggctgtgctgatgaaaagggtctgccctgagggccgctgttccngaaatgctgggtggtgtccctaccctttgcgggactgggaacgagacatggactctccttgctctaggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301234 - DNA, 961 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301235 - DNA, 1854 bp, Homo sapiens
cagacactgcagagggtgatgtgtggaatctaccacgtgcgccatgctgcctttctaaaggccaaacagttttaaaatctagcctgaaggtttcagatcagggatttcggcctgtatatcaagagttagagttggccgggcacggtggctcacacctgtaatcccagcactttgggaggccgaggcgggcagattgtttgagcctcaggagttggagaacagcttgggcaatgtggcaaaagtctgtctctacaaaaaatacaaaaattaggcaggcgtggtgttacacgcctgtagtcccaactactcgggaggctgaggtgggaggattgcttgaacccaggaggcagaggctgcagtgaaccgagatcatgtcactgtactccagtctgggcgacacagcaagaccctgtctccaaaaaaaaaaaaaaaaaagttgggggaagcattccatgtgcagatggagggactggcccgagtcaaggtgggaggcgtgcaaacgcaggctctcacagtgcgtggccagcagcgtgggccccggcacggggcatggagcagagtagacagtgctgagtcctgctcactgtcctgtctggggagtcatcacatctactggaggtggctcagggcaggctccatctcttgcccagggcagcagggtgggccctgtggctgtactctttgttgctgccctaaagtgccaagagaacttgttttggaatcataaatcctgagtttgcagcctgttgctctcaactcttccctggttgtgtgacctcaggcaagtcaccctttctggtttgttttcccatctgcaaaacaggatgagagccagtaaggccccttcccgccctcaagttctatgtctctggtggctttaaaggtggagtcgtttctgctgctcatctgcagtgccgagtggcagtgcctcatcccactctcagtccgtgacctggagggtgggtttataccttggaccacagtcagaggtgccgggttctcagcggcccccatcttggtccaaggctgggcctctcacctgcccctctctctcccctcagtggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301236 - DNA, 3013 bp, Homo sapiens
  misc_feature (2242)..(2242): n is a, c, g, or t
cagacactgcagagggtgatgtgtggaatctaccacgtgcgccatgctgcctttctaaaggccaaacagttttaaaatctagcctgaaggtttcagatcagggatttcggcctgtatatcaagagttagagttggccgggcacggtggctcacacctgtaatcccagcactttgggaggccgaggcgggcagattgtttgagcctcaggagttggagaacagcttgggcaatgtggcaaaagtctgtctctacaaaaaatacaaaaattaggcaggcgtggtgttacacgcctgtagtcccaactactcgggaggctgaggtgggaggattgcttgaacccaggaggcagaggctgcagtgaaccgagatcatgtcactgtactccagtctgggcgacacagcaagaccctgtctccaaaaaaaaaaaaaaaaaagttgggggaagcattccatgtgcagatggagggactggcccgagtcaaggtgggaggcgtgcaaacgcaggctctcacagtgcgtggccagcagcgtgggccccggcacggggcatggagcagagtagacagtgctgagtcctgctcactgtcctgtctggggagtcatcacatctactggaggtggctcagggcaggctccatctcttgcccagggcagcagggtgggccctgtggctgtactctttgttgctgccctaaagtgccaagagaacttgttttggaatcataaatcctgagtttgcagcctgttgctctcaactcttccctggttgtgtgacctcaggcaagtcaccctttctggtttgttttcccatctgcaaaacaggatgagagccagtaaggccccttcccgccctcaagttctatgtctctggtggctttaaaggtggagtcgtttctgctgctcatctgcagtgccgagtggcagtgcctcatcccactctcagtccgtgacctggagggtgggtttataccttggaccacagtcagaggtgccgggttctcagcggcccccatcttggtccaaggctgggcctctcacctgcccctctctctcccctcagtggtggctggacctcgtggaagcccctctggctgtgtggctatggactcacgcagagcactgtcggcatcatcgggctggggcgcataggtgaggctcccaccggcccgcttgcccgccccggctctcacagcgtggtttgcatccctggcaccacgtgtctgaaggctgagaagacccacatgctgtcagggcactttgcttgcagtagagatatctctaatgagggatacagctttgtaaaacacaggcaaatacataaataaaccaaagcaggattccttaagaactcaccaggtgataaaagcaagttgcctaagggtcagggggcttcatgattccggctccataaagaacagatgaagactacaaatgtgttggggccgttaggagtggttaccgtgagagagcccattcccccgacacctactccggcttgcgttctggaaggtatgtgactcacaaagccctaactcgggccggagggctcagtgggcagagttgatctgcagttctgcagatgaggcagagacacttttcttccagtggcccttatttggagaagcctggcagaagggcgtgagcctagccaagcagctatctattggtggttctctgtcatcctgcctggtgcaggggtgcgggtgagggtggagagtgtggagaacctgtctagccaacgaacagccctgcctctcactagagagttgcttggaggaacccaacagctttggggcacgttctgagcctgaaaatccaactgtacaaatctgtctcagcagcagcttacatgaaaattgtaagtttggggtgagctggcagtttggcagtgccaccaaaaagtcaaatggggtctgagactgcattcacagaagcagagggtccaggacaaaggaggggactgcttgaccaggtgtctcctttgtgaaaacctctccagttctcagaggttaggaaaaacctgagtggctttccagatggcttggaccatgtgaggacagcatcagccagtcacagtctcaggggagctgaggtgctgtctccagatccctggggcagtgtgggctggctgggggctagttacagtggggcagccagccccccacccgctttggaggagacaggagcaggcaactcgggctgtgctgatgaaaagggtctgccctgagggccgctgttccngaaatgctgggtggtgtccctaccctttgcgggactgggaacgagacatggactctccttgctctaggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301237 - DNA, 1956 bp, Homo sapiens
  misc_feature (1193)..(1193): n is a, c, g, or t
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttggtaagtgaagccttgatttccacaggagcctatctgtgcccagttgagaggctgtattttctctcaatggtggcattttcaggcagagggcaggagctccaggcatgtccaggggctgctgtctggtagatgtttaatctacctgcccctggacactggcccactcagggagcacagggacttacccaggtcctctccgagccagcagagcagtccagggctcccgtctttcagagtcctttgttaccattccccattgtgggcggagcagcggggatggtggtgggtgtgaggaagggctgggcactttcactgtcttttccttcataaactggcaagcactaccctagcctttgtgtgcgccccttagtccaggcggatccagcacctggcgggtccacagcctggtgagcagatggcaggctggatctcaagcattccccacgcccctgggcactttgggccctgaaggtagttaaagccagagtggtccagatcccactgtgtgtnatttgactttgtgcactcatgagagttgtccaggtagagactcggccttcaggaagcatcttgggagtttctgttagggagtcgggagcaaggggctggtctcccgccatctggttgtccctagcctgggactcagtgcctgatggagtcctgccctccctcagtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301238 - DNA, 2958 bp, Homo sapiens
  misc_feature (2187)..(2187): n is a, c, g, or t
cagacactgcagagggtgatgtgtggaatctaccacgtgcgccatgctgcctttctaaaggccaaacagttttaaaatctagcctgaaggtttcagatcagggatttcggcctgtatatcaagagttagagttggccgggcacggtggctcacacctgtaatcccagcactttgggaggccgaggcgggcagattgtttgagcctcaggagttggagaacagcttgggcaatgtggcaaaagtctgtctctacaaaaaatacaaaaattaggcaggcgtggtgttacacgcctgtagtcccaactactcgggaggctgaggtgggaggattgcttgaacccaggaggcagaggctgcagtgaaccgagatcatgtcactgtactccagtctgggcgacacagcaagaccctgtctccaaaaaaaaaaaaaaaaaagttgggggaagcattccatgtgcagatggagggactggcccgagtcaaggtgggaggcgtgcaaacgcaggctctcacagtgcgtggccagcagcgtgggccccggcacggggcatggagcagagtagacagtgctgagtcctgctcactgtcctgtctggggagtcatcacatctactggaggtggctcagggcaggctccatctcttgcccagggcagcagggtgggccctgtggctgtactctttgttgctgccctaaagtgccaagagaacttgttttggaatcataaatcctgagtttgcagcctgttgctctcaactcttccctggttgtgtgacctcaggcaagtcaccctttctggtttgttttcccatctgcaaaacaggatgagagccagtaaggccccttcccgccctcaagttctatgtctctggtggctttaaaggtggagtcgtttctgctgctcatctgcagtgccgagtggcagtgcctcatcccactctcagtccgtgacctggagggtgggtttataccttggaccacagtcagaggtgccgggttctcagcggcccccatcttggtccaaggctgggcctctcacctgcccctctctctcccctcagtggtggctggacctcgtggaagcccctctggctgtgtggctatggactcacgcagagcactgtcggcatcatcgggctggggcgcataggtgaggctcccaccggcccgcttgcccgccccggctctcacagcgtggtttgcatccctggcaccacgtgtctgaaggctgagaagacccacatgctgtcagggcactttgcttgcagtagagatatctctaatgagggatacagctttgtaaaacacaggcaaatacataaataaaccaaagcaggattccttaagaactcaccaggtgatagatgaagactacaaatgtgttggggccgttaggagtggttaccgtgagagagcccattcccccgacacctactccggcttgcgttctggaaggtatgtgactcacaaagccctaactcgggccggagggctcagtgggcagagttgatctgcagttctgcagatgaggcagagacacttttcttccagtggcccttatttggagaagcctggcagaagggcgtgagcctagccaagcagctatctattggtggttctctgtcatcctgcctggtgcaggggtgcgggtgagggtggagagtgtggagaacctgtctagccaacgaacagccctgcctctcactagagagttgcttggaggaacccaacagctttggggcacgttctgagcctgaaaatccaactgtacaaatctgtctcagcagcagcttacatgaaaattgtaagtttggggtgagctggcagtttggcagtgccaccaaaaagtcaaatggggtctgagactgcattcacagaagcagagggtccaggacaaaggaggggactgcttgaccaggtgtctcctttgtgaaaacctctccagttctcagaggttaggaaaaacctgagtggctttccagatggcttggaccatgtgaggacagcatcagccagtcacagtctcaggggagctgaggtgctgtctccagatccctggggcagtgtgggctggctgggggctagttacagtggggcagccagccccccacccgctttggaggagacaggagcaggcaactcgggctgtgctgatgaaaagggtctgccctgagggccgctgttccngaaatgctgggtggtgtccctaccctttgcgggactgggaacgagacatggactctccttgctctaggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301239 - DNA, 2643 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggtatcctagggccaccttacccagcaagcctggagaggagccatccccactgctgccatctggagattttcttccccgtgggttgttggtgagaccccaggctgagcttgctggtttccataaaccaaacaaccaactcagaaattcgtgggaatacacgagacctccgtacagggaagaagagccgtcagagtgggcctggcctgtctgcttctcagcagtggcccccacccggcggggcctggcacacagcagcgtggcttcagggagtgttcccagggagcctctgcaggcccattatcctccaccacaaagggctggacttgaggatctgaagggccctctggaggccgcctcccacactgctgagcctggctttgtctggctgtggttcagtgatactttgaaccttatgctcctgggcggacagaccctaaaactcacgtggtcgtagctcctcacactgtccctaggggtgccttcaggccactgggcatgtatggaggtcagaccttccttctctgccactccaagcccttcctagctggtgccccttgagcctgtttacatcagtttaggggaagggggattgggtgaggtcatcctgaggactcgtccaccccaaaggtacctgtaattaccaacatttagctacaaaacaggtgacctgggaatggaagagtgaaacatgcaggaccacagggctcgcactgctggctggcagcagtcacagctgccgtgtactgggtgcctgcgtgtacccaggacagcccaggaccgtgtattactcattagtgcacaagtattacttagtgcacaatatacagtctctagaagatgacttcttgccttcagtcgccgctccctttgatggctgtggttaggggtgtgctcgttcctctgccctggtttagacaggtacctgatagcacactgtggtgcttctcagtgggggtctgggggtcaaccagatcagaaacacttggatggggcctaacacagatgcccttctgggccctgttcatgcagtagagcatgtaagaaagctttaatcctcccaacatgcctgggagttaggtggtattctccttatctcacagagtagataatttgagacacagataattcgaggcacagagaatttgagacacttgcccaaggtcacacagctagaaggaggcagggctggagttctctgagtatataagacttacagacatactgtaagtatacctaagacttactgctttaaaagtcagtgccaagtgagtggaaaaattcattctgtaggttgttctgcctcaaaggtggcctgggcggagggatcttcggggtacccatgtcaccactgtcattcccaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301240 - DNA, 1268 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtggtaagaactgcactttctgatgcaaactccctgctgccctgcaggaccagtgtttttgagggggtcccaaggggccgggtgtggagctagtgtgagcaggtgttgaacccaaagggacacaccagggaccgtaaatgtttatgttgtcagtgacatgggtgtatgacaggagcagtcctcttgcgcatgctctgctgggtctctgtccctaaaggaacagaatgtaggtgtgagtggatttgtttaaaaaaaaagagtgggccaggcgtggttgtccgggccagtctctgcccttaatttggattctggaatggaaac

SEQ ID NO: 301241 - DNA, 1182 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301242 - DNA, 1024 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagagggaaggtgtgattctctgaggaaagagtgattctgatatatgtacttgtcacattggtgttggacacatttgcgccaaaagtatggtaattctattattaaataattctctgagaaa

SEQ ID NO: 301243 - DNA, 1005 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagactcctgggttcaagcgattctcctgcctcagcttcccgagtagctgggattacaggcgtgtaccaccatactacagttcttcagggtcaggagagggtc

SEQ ID NO: 301244 - DNA, 3068 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggtatcctagggccaccttacccagcaagcctggagaggagccatccccactgctgccatctggagattttcttccccgtgggttgttggtgagaccccaggctgagcttgctggtttccataaaccaaacaaccaactcagaaattcgtgggaatacacgagacctccgtacagggaagaagagccgtcagagtgggcctggcctgtctgcttctcagcagtggcccccacccggcggggcctggcacacagcagcgtggcttcagggagtgttcccagggagcctctgcaggcccattatcctccaccacaaagggctggacttgaggatctgaagggccctctggaggccgcctcccacactgctgagcctggctttgtctggctgtggttcagtgatactttgaaccttatgctcctgggcggacagaccctaaaactcacgtggtcgtagctcctcacactgtccctaggggtgccttcaggccactgggcatgtatggaggtcagaccttccttctctgccactccaagcccttcctagctggtgccccttgagcctgtttacatcagtttaggggaagggggattgggtgaggtcatcctgaggactcgtccaccccaaaggtacctgtaattaccaacatttagctacaaaacaggtgacctgggaatggaagagtgaaacatgcaggaccacagggctcgcactgctggctggcagcagtcacagctgccgtgtactgggtgcctgcgtgtacccaggacagcccaggaccgtgtattactcattagtgcacaagtattacttagtgcacaatatacagtctctagaagatgacttcttgccttcagtcgccgctccctttgatggctgtggttaggggtgtgctcgttcctctgccctggtttagacaggtacctgatagcacactgtggtgcttctcagtgggggtctgggggtcaaccagatcagaaacacttggatggggcctaacacagatgcccttctgggccctgttcatgcagtagagcatgtaagaaagctttaatcctcccaacatgcctgggagttaggtggtattctccttatctcacagagtagataatttgagacacagataattcgaggcacagagaatttgagacacttgcccaaggtcacacagctagaaggaggcagggctggagttctctgagtatataagacttacagacatactgtaagtatacctaagacttactgctttaaaagtcagtgccaagtgagtggaaaaattcattctgtaggttgttctgcctcaaaggtggcctgggcggagggatcttcggggtacccatgtcaccactgtcattcccaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaaaaaaaaaaaaaaaaaaaaaaaaaaaaaaaaaaaaaaaaaaaaaaaaaaaaaaaaaaaaaaaaaaaaaaaaaaaaaaacctgtgtgcgcggcgcgcccgccgcgcgcgccccgaaaaaacttaaaacaccaccgggggggcggcgcgggccaccacaggacgagaacagaagagaacgaggggcataacacgaggtgcttccaagagagaacatctgggaggcacaacaagacagggggaggggtgactctctccacaaagagaataaaaaaagcgcggcgggtgagacaacaacgacgagggtagtaagaaaaaaacaacaaacagagggggtcttcggagggaggaactcaacggggggggttactaccacagcgaggggcccacaagagagggggcgcaaaacaagaaaggccgccgccgggg

SEQ ID NO: 301245 - DNA, 1093 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301246 - DNA, 2622 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggtatcctagggccaccttacccagcaagcctggagaggagccatccccactgctgccatctggagattttcttccccgtgggttgttggtgagaccccaggctgagcttgctggtttccataaaccaaacaaccaactcagaaattcgtgggaatacacgagacctccgtacagggaagaagagccgtcagagtgggcctggcctgtctgcttctcagcagtggcccccacccggcggggcctggcacacagcagcgtggcttcagggagtgttcccagggagcctctgcaggcccattatcctccaccacaaagggctggacttgaggatctgaagggccctctggaggccgcctcccacactgctgagcctggctttgtctggctgtggttcagtgatactttgaaccttatgctcctgggcggacagaccctaaaactcacgtggtcgtagctcctcacactgtccctaggggtgccttcaggccactgggcatgtatggaggtcagaccttccttctctgccactccaagcccttcctagctggtgccccttgagcctgtttacatcagtttaggggaagggggattgggtgaggtcatcctgaggactcgtccaccccaaaggtacctgtaattaccaacatttagctacaaaacaggtgacctgggaatggaagagtgaaacatgcaggaccacagggctcgcactgctggctggcagcagtcacagctgccgtgtactgggtgcctgcgtgtacccaggacagcccaggaccgtgtattactcattagtgcacaagtattacttagtgcacaatatacagtctctagaagatgacttcttgccttcagtcgccgctccctttgatggctgtggttaggggtgtgctcgttcctctgccctggtttagacaggtacctgatagcacactgtggtgcttctcagtgggggtctgggggtcaaccagatcagaaacacttggatggggcctaacacagatgcccttctgggccctgttcatgcagtagagcatgtaagaaagctttaatcctcccaacatgcctgggagttaggtggtattctccttatctcacagagtagataatttgagacacagataattcgaggcacagagaatttgagacacttgcccaaggtcacacagctagaaggaggcagggctggagttctctgagtatataagacttacagacatactgtaagtatacctaagacttactgctttaaaagtcagtgccaagtgagtggaaaaattcattctgtaggttgttctgcctcaaaggtggcctgggcggagggatcttcggggtacccatgtcaccactgtcattcccaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacattgacgaggttgattaatttttcctccg

SEQ ID NO: 301247 - DNA, 2322 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggtatcctagggccaccttacccagcaagcctggagaggagccatccccactgctgccatctggagattttcttccccgtgggttgttggtgagaccccaggctgagcttgctggtttccataaaccaaacaaccaactcagaaattcgtgggaatacacgagacctccgtacagggaagaagagccgtcagagtgggcctggcctgtctgcttctcagcagtggcccccacccggcggggcctggcacacagcagcgtggcttcagggagtgttcccagggagcctctgcaggcccattatcctccaccacaaagggctggacttgaggatctgaagggccctctggaggccgcctcccacactgctgagcctggctttgtctggctgtggttcagtgatactttgaaccttatgctcctgggcggacagaccctaaaactcacgtggtcgtagctcctcacactgtccctaggggtgccttcaggccactgggcatgtatggaggtcagaccttccttctctgccactccaagcccttcctagctggtgccccttgagcctgtttacatcagtttaggggaagggggattgggtgaggtcatcctgaggactcgtccaccccaaaggtacctgtaattaccaacatttagctacaaaacaggtgacctgggaatggaagagtgaaacatgcaggaccacagggctcgcactgctggctggcagcagtcacagctgccgtgtactgggtgcctgcgtgtacccaggacagcccaggaccgtgtattactcattagtgcacaagtattacttagtgcacaatatacagtctctagaagatgacttcttgccttcagtcgccgctccctttgatggctgtggttaggggtgtgctcgttcctctgccctggtttagacaggtacctgatagcacactgtggtgcttctcagtgggggtctgggggtcaaccagatcagaaacacttggatggggcctaacacagatgcccttctgggccctgttcatgcagtagagcatgtaagaaagctttaatcctcccaacatgcctgggagttaggtggtattctccttatctcacagagtagataatttgagacacagataattcgaggcacagagaatttgagacacttgcccaaggtcacacagctagaaggaggcagggctggagttctctgagtatataagacttacagacatactgtaagtatacctaagacttactgctttaaaagtcagtgccaagtgagtggaaaaattcattctgtaggttgttctgcctcaaaggtggcctgggcggagggatcttcggggtacccatgtcaccactgtcattcccaggggcgacgtcgtaaaccaggacgacctgtaccaggccttggccagtggtaagattgcagctgctggactggatgtgacgagcccagaaccactgcctacaaaccaccctctcctgaccctgaagaactgtgtgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301248 - DNA, 1000 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301249 - DNA, 1075 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacactgattctgccccacattggcagtgccacccacagaacccgcaacaccatgtccttgttggcagctaacaacttgctggctggcctgagaggggagccgatgcctagtgaactcaagctgtagccaaacagtagagatggagggccgggaagcaaaccgtgccctggtattgtcagacacacccaggcttgatttggatccacaggcagagccaagggaaggtgtgattctctgaggaaagagtgattctgatatatgtacttgtcacattggtgttggacacatttgcgccaaaagtatggtaattctattattaaataattctctgagaaa

SEQ ID NO: 301250 - DNA, 2601 bp, Homo sapiens
  misc_feature (1670)..(1670): n is a, c, g, or t
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggtgaggctcccaccggcccgcttgcccgccccggctctcacagcgtggtttgcatccctggcaccacgtgtctgaaggctgagaagacccacatgctgtcagggcactttgcttgcagtagagatatctctaatgagggatacagctttgtaaaacacaggcaaatacataaataaaccaaagcaggattccttaagaactcaccaggtgataaaagcaagttgcctaagggtcagggggcttcatgattccggctccataaagaacagatgaagactacaaatgtgttggggccgttaggagtggttaccgtgagagagcccattcccccgacacctactccggcttgcgttctggaaggtatgtgactcacaaagccctaactcgggccggagggctcagtgggcagagttgatctgcagttctgcagatgaggcagagacacttttcttccagtggcccttatttggagaagcctggcagaagggcgtgagcctagccaagcagctatctattggtggttctctgtcatcctgcctggtgcaggggtgcgggtgagggtggagagtgtggagaacctgtctagccaacgaacagccctgcctctcactagagagttgcttggaggaacccaacagctttggggcacgttctgagcctgaaaatccaactgtacaaatctgtctcagcagcagcttacatgaaaattgtaagtttggggtgagctggcagtttggcagtgccaccaaaaagtcaaatggggtctgagactgcattcacagaagcagagggtccaggacaaaggaggggactgcttgaccaggtgtctcctttgtgaaaacctctccagttctcagaggttaggaaaaacctgagtggctttccagatggcttggaccatgtgaggacagcatcagccagtcacagtctcaggggagctgaggtgctgtctccagatccctggggcagtgtgggctggctgggggctagttacagtggggcagccagccccccacccgctttggaggagacaggagcaggcaactcgggctgtgctgatgaaaagggtctgccctgagggccgctgttccngaaatgctgggtggtgtccctaccctttgcgggactgggaacgagacatggactctccttgctctaggccaggccattgctcggcgtctgaaaccattcggtgtccagagatttctgtacacagggcgccagcccaggcctgaggaagcagcggaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggtatcctagggccaccttacccagcaagcctggagaggagccatccccactgctgccatctggagattttcttccccgtgggttgttggtgagaccccaggctgagcttgctggtttccataaaccaaacaaccaactcagaaattcgtgggaatacacgagacctccgtacagggaagaagagccgtcagagtgggcctggcctgtctgcttctcagcagtggcccccacccggcggggcctggcacacagcagcgtggcttcagggagtgttcccagggagcctctgcaggcccattatcctccaccacaaagggctggacttgaggatctgaagggccctctggaggccgcctcccacactgctgagcctggctttgtctggctgtggttcagtgatactttgaaccttatgctcctgggcggacagaccctaaaactcacgtggtcgtagctcctcacactgtccctaggggtgccttcaggccactgggcatgtatggaggggaaggtgtgattctctgaggaaagagtgattctgatatatgtacttgtcacattggtgttggacacatttgcgccaaaagtatggtaattctattattaaataattctctgagaaa

SEQ ID NO: 301251 - DNA, 795 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaagtaagtgaacgcagaccaggtgcggtggctcacggctgtaatcccagcactttgggaggccaaagtgagcggatcatgaggttaggagttcgagaccagtctggccaacatagtgaaaccccgtctctagtaaaaatacaaaaaaaattagctgggtgtggtggtgggtccctgtaatcccagctacttgggaggctgaggcaggagaatcatgtgaacccaggagacagaggttgcagtgagctgagatcacaccattgcactccagcccaggtgacggtgtgagactctgtctcaaaaaaaaaa

SEQ ID NO: 301252 - DNA, 1311 bp, Homo sapiens
actccagcctggccccgccccggcccagctacattcccgggccagcttctgtactgccaggtccgggtcggcggctgcactgcggatgagaccggtgcgactcatgaaggtgttcgtcacccgcaggatacccgccgaggctgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcggtaactgcagcttgggatctggagggggcctagagagaggggtggctatgagagaaagaagagctgttgatttgtttttactgcatatccctcggccattcagggagaatgtgaggtggctgatgatagaatctgtccacatgtgcacaggtcagttacaataaaccccagcagtcagaaacagtgggtaacttctgtgtaggtggcaccctttcacattcattatcttttttgatccccacaacaataccttgaagtagcaaaggcaggtgttattctttctgtttcagatgaggaaattcagaaaggttaagttacttgttcagtccctgaaccctgatcttccatcttcatatccttccaaagtgggagataatctaaataggaatgaggactgcccgtttttgagtgctcatttatagttctgagcttcctggcaggcagatcaaagagggagcaaagtaactccatggaaatgtcccagcagtagacattggtaaatatggttgaggctgatgttaccacccagatgtctgattcgtagtgggatccgagttggctacaccccagatgtcctgacagataccaccgccgaactcgcagtctccctgctacttaccacctgccgccggttgccggaggccatcgaggaagtgaagaagtaagtgaacgcagaccaggtgcggtggctcacggctgtaatcccagcactttgggaggccaaagtgagcggatcatgaggttaggagttcgagaccagtctggccaacatagtgaaaccccgtctctagtaaaaatacaaaaaaaattagctgggtgtggtggtgggtccctgtaatcccagctacttgggaggctgaggcaggagaatcatgtgaacccaggagacagaggttgcagtgagctgagatcacaccattgcactccagcccaggtgacggtgtgagactctgtctcaaaaaaaaaa

SEQ ID NO: 301253 - DNA, 133 bp, Homo sapiens
atgacaggagcagtcctcttgcgcatgctctgctgggtctctgtccctaaaggaacagaatgtaggtgtgagtggatttgtttaaaaaaaaagagtgggccaggcgtggtggctcatgcctgtaatcccagca

SEQ ID NO: 301254 - DNA, 414 bp, Homo sapiens
ttctagtaataacacagaagtgattattaccagacaagcatcagtgaagtatactgccttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 301255 - DNA, 1520 bp, Homo sapiens
agatgtggccaaagaaatggctgacaccctccctctaccccatacaactattcccctagattattctttatcctcatgacatcaggataaacattaatgttgtcacagtagcagtaggtagaatattgttcgtttagtctaatattaggctatttctcccagtagattcattgctaatgcaattgaattataaatttgggcagagttttagagaaaattgccattaaatcaatcagcttgttgtaggagcttgtctatatgctaatagcattggtgctggcatatttgggcagtaatttcagcattgcatacataaatttgctattgttacatttggattaatattaaaacctgagtttatagtgtttcaggtgtagttgaattatatgtaagtagatataaattttgttatttttgtgttaaagaactagtggcagtgtgggctttagtacagtaatgtattttttgttcattgtgagaaattttattgatgccatgtgtacactgaaacttaaagcctttttaggtggagaaacggtgggactgtttgtagatgctatctctgtcgatagtggatgcccattttagataagattcttgttctgcctgtggaatccttaatagtttaaaatcaatacttctcgagtagtttctaaagactgtttgccgatctgtttttaaaaccaaggtttaaaaaaatctttcaagtcttcctatgatgtttagtgcacctgtgaaaatggtaaaatgattgttttggaatttttggatctgacgttgatttagggatgaatggtttgagttttatttgtcaaaatttgctgtttttatatctacaggattttttttcctataagcataaaatcaaagttggctactgttatttactgtgatgtaatgaatttgaactgccctgattgaaaagtttgcatttaggaaattataacgtggaaaaactgagcatatgattaacatctcccagctctttaaaacagaattaggattttgtttttagtactggctgttaccagtgttttaaaggaatttcttgagtgaagcgatcattttacaaaattagagaagcaagtagtatggtgattggcaggaatttctcagatttgaatcaagttctgatgttaaaatggaagattctgtttaaagcttgtattttcaaggaatacttataaacatttttatcaggcatcttcctgtttctcttaaatacttccttttttgacttaaaaatgttagccagtgaatgcttgacaaatttgtgtttttgtccttttcagttttgtcactcagcccagtccatcagtttctcagcccagtacttctcagagtgaagaaaaagctcctgaattgcccaaaccaaagaaaaacagatgtttcatgtgcagaaagaaagttggtcttacaggtattacaaaacacaagacaatgtatgttttacttctgcagttaacaaggagcttttggtcactccctaagagactagttggtcttacacataaaaaaaa

SEQ ID NO: 301256 - DNA, 633 bp, Homo sapiens
tttgaaagttgttgtatactgttaacgattgtctgcccatgtcctgcctgaaataccatgattgtttatggaaagtatctttaataaagctggatacagtttggcttggaaaaaaaaaaaaaaaaaaaaaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagcctatgtttaggcctcccctaattggtgtaatctgcccagcaatgtgacccggttatggaccaatgttttccagtgccaacaatagtctctcttttg

SEQ ID NO: 301257 - DNA, 312 bp, Homo sapiens
ttttcaagttaaaaatgaagtaagagtggtatagagaaggtaagatgagccctcggactccatcactctgaaggtctgagtagtagctgagattgcgccattgcactccagcctgggccaaaagagcaaaactccgtctcaaaaaaaaaaatatatatatatagccaggcaacgtggcgtgtgcctataatcccaagctatttgggaggctgaggcaggagaatcgcttgaacccaggaggcggaggttgcaatgagccgagatagcaccactgcactccagcctggtgacaaaacaagactccgtctcaaa

SEQ ID NO: 301258 - DNA, 3058 bp, Homo sapiens
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcgccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 301259 - DNA, 3014 bp, Homo sapiens
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgcctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcgccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 301260 - DNA, 2921 bp, Homo sapiens
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcaggcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcgccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 301261 - DNA, 4076 bp, Homo sapiens
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggtgagtgatacggggctgcgggtgggagccgggctccttgttgccgggccgggggcgggagggagcccgcccgccagcccaggaagcacaaagacggaggcgtcatcctgtcgtcgtggcccgagacctggctcccggcgtccctggctcgctccacagcacggtcgggaaacaatgcacggcgtgccgcctctgcggggccggcctctaggccgctcgcctccgcggcggcgcccggcgtgggcaccacgacccagagaaacaaagaggccgaggcggcggccgcgccccctgcccgttgcagccccccctagctctcccctaagaggagccgttcggggtcgggggtcgggggtcggggatccgcgtggggcctgcaggcgaagggctggccgggcctgctgagctgctgttctgcatgactcagtggttttcggagagggccctgttgggctttattgagtgaggcctttgcttagagggggatggggtatcagtgggacccgaacttgttccaaaatccattggaacatggggccgggggttctcggcgtcgtcttttgggcttctcgacgtcgctgcgtttttatcctgagatccgttttcatggaggaaatggaacacctcctttgtttggtgcatttaggctgatgaatgtgaaattttttgctcgctttccacgcactccgtggaggtgtgttttcggggaagggtcggattatctttattgattgaatgtctcctaagggatagcatctaaggagataccaagataaaggaacatataggtcacacatccccgttcttaaacctgggatttagatacagacttctaaaaacataaacgaatgtattttattccttatttttaggattttttttaaagagtaggctttcagaactcagttggtgaaaatactgcaattttatctttgaagttttttgttaaaatgtttccccacacccccctaaaaaattaaggattctttgtagttgtctcctgttttctatctcccaggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcgccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 301262 - DNA, 4147 bp, Homo sapiens
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggtgagtgatacggggctgcgggtgggagccgggctccttgttgccgggccgggggcgggagtgaagggaccggggcgccgcgggccaatggcgaagccggagcaggccgcggatggcggcgtccgggggaggggagcccgcccgccagcccaggaagcacaaagacggaggcgtcatcctgtcgtcgtggcccgagacctggctcccggcgtccctggctcgctccacagcacggtcgggaaacaatgcacggcgtgccgcctctgcggggccggcctctaggccgctcgcctccgcggcggcgcccggcgtgggcaccacgacccagagaaacaaagaggccgaggcggcggccgcgccccctgcccgttgcagccccccctagctctcccctaagaggagccgttcggggtcgggggtcgggggtcggggatccgcgtggggcctgcaggcgaagggctggccgggcctgctgagctgctgttctgcatgactcagtggttttcggagagggccctgttgggctttattgagtgaggcctttgcttagagggggatggggtatcagtgggacccgaacttgttccaaaatccattggaacatggggccgggggttctcggcgtcgtcttttgggcttctcgacgtcgctgcgtttttatcctgagatccgttttcatggaggaaatggaacacctcctttgtttggtgcatttaggctgatgaatgtgaaattttttgctcgctttccacgcactccgtggaggtgtgttttcggggaagggtcggattatctttattgattgaatgtctcctaagggatagcatctaaggagataccaagataaaggaacatataggtcacacatccccgttcttaaacctgggatttagatacagacttctaaaaacataaacgaatgtattttattccttatttttaggattttttttaaagagtaggctttcagaactcagttggtgaaaatactgcaattttatctttgaagttttttgttaaaatgtttccccacacccccctaaaaaattaaggattctttgtagttgtctcctgttttctatctcccaggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcgccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 301263 - DNA, 3292 bp, Homo sapiens
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggtgagtgatacggggctgcgggtgggagccgggctccttgttgccgggccgggggcgggagtgaagggaccggggcgccgcgggccaatggcgaagccggagcaggccgcggatggcggcgtccgggggaggggagcccgcccgccagcccaggaagcacaaagacggaggcgtcatcctgtcgtcgtggcccgagacctggctcccggcgtccctggctcgctccacagcacggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcgccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 301264 - DNA, 3389 bp, Homo sapiens
  misc_feature (3070)..(3070): n is a, c, g, or t
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcgccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaaaaaaaaaaaaanaaaaaaaacaaaaaaaacaaaaaaaaaaaaaaaaaaaaaaaaaaaaaaatttgggggggggtgggggctcaaaaaaacgttttgaaaacaccctggggggggacgcgggggcccacaagaggagaaagcaaaacggtggcaacaaaggggtgccaaaagaagaaactcgtggcgaaaaagaaagggggggggactatccacaaaaataaaaaagcgcgggggggcacacaaggggttgtgcgaaacaccacacagagagcctaggagaaaaaagagggacaaaacaaggggagtacaagagagccgaacaaaaaatccg

SEQ ID NO: 301265 - DNA, 3004 bp, Homo sapiens
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggtacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcgccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 301266 - DNA, 3155 bp, Homo sapiens
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggtgagtgatacggggctgcgggtgggagccgggctccttgttgccgggccgggggcgggagtgaagggaccggggcgccgcgggccaatggcgaagccggagcaggccgcggatggcggcgtccgggggaggggagcccgcccgccagcccaggaagcacaaagacggaggcgtcatcctgtcgtcgtggcccgagacctggctcccggcgtccctggctcgctccacagcacgcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcgccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 301267 - DNA, 2936 bp, Homo sapiens
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcgccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 301268 - DNA, 3453 bp, Homo sapiens
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcgccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaaacttcacttgttcattgggtttttaagccatagttggagtcctaaagggggaaaattagaaaatgttactttacatggctatataattttttttcctttgccatcgctgaacttgttcaagtgataatcaagagatattagaagcatttgcaggtatgatacctgataggcagtttatttttgaagaattcaataggcacctttgggattaaaacaattttaaaatttgagaaagatgaaatttgaacaattatggcctacctcgcttctccatgttgtaaaagatgatgttttatgataattctgaagaagaaagtaggtatgacttagtttacaaaaagagttctgttttatttctgttttgggtttggctctaatacagagattcacccatg

SEQ ID NO: 301269 - DNA, 3005 bp, Homo sapiens
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 301270 - DNA, 2152 bp, Homo sapiens
ttcaatttctacaccacagcactaattcacattataaccacctgtcagctcatttgctctcttctctaagctattaaagtccaagacggcagagcctctatcatgtttaacactgtacccccaaacctacagggtctagtacagaatagacagtaaatctttgttgaaagaacgttcaatttctacactcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcgccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 301271 - DNA, 3003 bp, Homo sapiens
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcgccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 301272 - DNA, 3064 bp, Homo sapiens
agatgtggccaaagaaatggctgacaccctccctctaccccatacaactattcccctagattattctttatcctcatgacatcaggataaacattaatgttgtcacagtagcagtaggtagaatattgttcgtttagtctaatattaggctatttctcccagtagattcattgctaatgcaattgaattataaatttgggcagagttttagagaaaattgccattaaatcaatcagcttgttgtaggagcttgtctatatgctaatagcattggtgctggcatatttgggcagtaatttcagcattgcatacataaatttgctattgttacatttggattaatattaaaacctgagtttatagtgtttcaggtgtagttgaattatatgtaagtagatataaattttgttatttttgtgttaaagaactagtggcagtgtgggctttagtacagtaatgtattttttgttcattgtgagaaattttattgatgccatgtgtacactgaaacttaaagcctttttaggtggagaaacggtgggactgtttgtagatgctatctctgtcgatagtggatgcccattttagataagattcttgttctgcctgtggaatccttaatagtttaaaatcaatacttctcgagtagtttctaaagactgtttgccgatctgtttttaaaaccaaggtttaaaaaaatctttcaagtcttcctatgatgtttagtgcacctgtgaaaatggtaaaatgattgttttggaatttttggatctgacgttgatttagggatgaatggtttgagttttatttgtcaaaatttgctgtttttatatctacaggattttttttcctataagcataaaatcaaagttggctactgttatttactgtgatgtaatgaatttgaactgccctgattgaaaagtttgcatttaggaaattataacgtggaaaaactgagcatatgattaacatctcccagctctttaaaacagaattaggattttgtttttagtactggctgttaccagtgttttaaaggaatttcttgagtgaagcgatcattttacaaaattagagaagcaagtagtatggtgattggcaggaatttctcagatttgaatcaagttctgatgttaaaatggaagattctgtttaaagcttgtattttcaaggaatacttataaacatttttatcaggcatcttcctgtttctcttaaatacttccttttttgacttaaaaatgttagccagtgaatgcttgacaaatttgtgtttttgtccttttcagttttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcgccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 301273 - DNA, 1714 bp, Homo sapiens
ccggtggggtgatcggccgaggaaacacgaaaacagatgttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcgccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 301274 - DNA, 2125 bp, Homo sapiens
ctcagaccttgatggttgttttcacttgaggaagcattacttaagatatggtaggactgtgttttgaatccagcttagcctaactccagagcctgtgtaaattttatcctgcgttgcatctacaggagtcgatagagggagagcatctggtagaaattagctggcagatagcccattttgttttctccacgtggtttggcttaccaaacacttcgctattgcccttgcaaggaaagactgaacatagttatttgaatttctcaccatgtcaaaggaagttaaaagttccttttccaggttaacgtgatagactctgtaagagttgactgtgtcttatcaccaggaagtggaagaaaagagttcactgtcttttatgttacaaagcaatgaaaatctggttccttttctatagtgactaaggctttttttttcttttaattgcctcaagttctcaaatgactctacttcttcgtttgtacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcgccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 301275 - DNA, 2281 bp, Homo sapiens
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataattaggttaacctctaggcccaacaggggtttggagacacctcgaagtctatgtagggcgggcccacatggtggtttcctccgttcttctgttttt

SEQ ID NO: 301276 - DNA, 2226 bp, Homo sapiens
  misc_feature (2129)..(2129): n is a, c, g, or t
  misc_feature (2134)..(2134): n is a, c, g, or t
  misc_feature (2159)..(2159): n is a, c, g, or t
  misc_feature (2170)..(2170): n is a, c, g, or t
  misc_feature (2221)..(2221): n is a, c, g, or t
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattgggncaatnctaaaagccggtcaaaattaggacnattcccggtgnaaaagggtaaacaatccgaaaacctggggttaaaaaggttaaaaacccatncaagg

SEQ ID NO: 301277 - DNA, 2308 bp, Homo sapiens
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataacatcagcacacaggtctggtaccttgagctatgactgctgacagagagttgatactatgtaaatggagaagactgctagataatgtacagagaataacttacgtagttacatcagagttatgatacagcttgattaagtgaagtctgatatatatgcgacttgcgatgtagtcaaa

SEQ ID NO: 301278 - DNA, 1876 bp, Homo sapiens
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgc

SEQ ID NO: 301279 - DNA, 1739 bp, Homo sapiens
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcaggcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgc

SEQ ID NO: 301280 - DNA, 1765 bp, Homo sapiens
  misc_feature (1731)..(1731): n is a, c, g, or t
  misc_feature (1758)..(1758): n is a, c, g, or t
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatggggacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtctttacttatcaattcaccaaggagctgttttttgcatctagncatcatactgccaggctgttatgcgtnggtaagg

SEQ ID NO: 301281 - DNA, 1468 bp, Homo sapiens
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggtaagttatttccaaggaaaaacacatttgaaagaactggtggacagaaatacagaaccaagaattggggctgagaatgctgaaagcacatggagagaacacctgataagagcttgaaattcaagcaacagcccaagtgcttgacatgactgatcaggaatgaatgactatctacaagcatcttatagcttttcagttttcttttttggggttattttgtttcacacttgtgttcattggattgactttttaatattttttgtttggatactcaagtataggattacagcacagtgaatgcttatatcactaacctaattaaatgcaagtatttattactacgtcttgatactaagtgagtttttgtagtgttcattggttccttacaaatccttt

SEQ ID NO: 301282 - DNA, 1331 bp, Homo sapiens
catcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcaggcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggtaagttatttccaaggaaaaacacatttgaaagaactggtggacagaaatacagaaccaagaattggggctgagaatgctgaaagcacatggagagaacacctgataagagcttgaaattcaagcaacagcccaagtgcttgacatgactgatcaggaatgaatgactatctacaagcatcttatagcttttcagttttcttttttggggttattttgtttcacacttgtgttcattggattgactttttaatattttttgtttggatactcaagtataggattacagcacagtgaatgcttatatcactaacctaattaaatgcaagtatttattactacgtcttgatactaagtgagtttttgtagtgttcattggttccttacaaatccttt

SEQ ID NO: 301283 - DNA, 734 bp, Homo sapiens
gagttctgttttatttctgttttgggtttggctctaatacagagattcacccatggacttggtctctgtagcgtttatgccagatcataaagaacaaggggtgacaggtacatgttgactttacctggggtaaatgattaccagagtgcaactgttgcttctctgtgatggagtttggggtggaaataccctagttttatctgtcagttctttgcatgctgctacttttgcttcaagttagggaggtacatatgtatgtcaaagttcctatactgacatagggtagtatttctctgaatatgaaaagtcacaattgagttgaaaatttagaagttgaagatttagaagggcaacttaatttttcaagttaaaaatgaagtaagagtggtatagagaaggtaagatgagccctcggactccatcactctgaaggtctgagtagtagcaagagatagatttttgtttggccaggctgcagtgcaatggcgtaatcttggctcactgcaacctctgcctcctgggttcaagtgattctcctgcctctgcctcctaagtagctgggatcacaggcaccagccaccacgcccagctaatttttgtatttttaatagagacagtttctccatgttggtcaggctggtcttgaactcctgacctcaggtgagctgcccgcctcggcctcccaaagtgctgggattacaggcgtgaggcaccgcacccggccaatcagtttt

SEQ ID NO: 301284 - DNA, 595 bp, Homo sapiens
tacaggtgttttaagaaaactttattcatccagtttaaagaactacctataaatatcaagactcagtgataattgtgattagccaattaagtaaaaacatttgaaatggtctgcctgtagtgcagcagagtgaaaagttaaagataccagtttcccaaattgattaaaacataaccctgagagctaacagaccttttcataaattgaaaccaagaatagtgataggtaaaaataccctaataattgataaaatttctttttgggtttttttttggtcctaaaacagtttgcttttataaaggcaacaaaatattgataattatctctgcccaccctttttaatgattaacggaatttgggcttttgttaaaacttgcgtagcaattacaacggtataccgatgattatattagactatattttggtgataacactaatttctgaaatttcgtttcatctatagcagaaaaatatggctcaggagactaaccagaccccggggcccatgctgtgtagcacaggatgtggcttttatggaaatcctaggacaaatggaatgtgttcagtttgctacaaagaacatcttcagaggcag

SEQ ID NO: 301285 - DNA, 375 bp, Homo sapiens
gcatccaatttttttttaaactttagattatctagctccatttgctcattttggaaatattctataatttaaagttgaactgacaacttattcattgtctcaagaagtacccttaacacctttaaaaattgtttgcttgaactcaaatagaaatgtgcctgtggctgccttgcctgtaactcagcaaatgacagaaatgagcatttcaagagaggacaaaataactaccccgaaaacagaggtgtcagagccaggtatgtttttcatttaatacttgttcagttctgaatttgatagtgcaagaaatggctggtggggggattctttccttcccattgaaggaccaaagaggagggagagccataaaatataggc

SEQ ID NO: 301286 - DNA, 507 bp, Homo sapiens
  misc_feature (17)..(17): n is a, c, g, or t
agggcaaactcccagangattttaaccttggtccaagtccaagcaattttagaatcccctggtggtctagtggttagattcgggcgcttttcaccgccgcgggccgggttcgtttcccggtcagggaacccttcctttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301287 - DNA, 602 bp, Homo sapiens
cgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaagtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattgcaagatccaagatcatgcctcattaccttctgcctgtaaaacctgccccagcccccagctccaggagacagatttgagccaggctcctgtctttctctgcagccttgcaataaacttttctttctacaaaaaccca

SEQ ID NO: 301288 - DNA, 427 bp, Homo sapiens
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301289 - DNA, 406 bp, Homo sapiens
  misc_feature (17)..(17): n is a, c, g, or t
cgccgccgccgacacgngcgagaagacgacagaagggctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301290 - DNA, 454 bp, Homo sapiens
gtttgagggcagcgatggctgtggagaaagctgccagcgctagcagagtcctcagcagggcctggggagggaggaggcagagagaaatctttgtgtttcaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301291 - DNA, 396 bp, Homo sapiens
gcggccgcctactactactaaattcgcggccgcgtcgacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301292 - DNA, 390 bp, Homo sapiens
  misc_feature (1)..(1): n is a, c, g, or t
naagtataggctaggtacgaggctgggtggtcgctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301293 - DNA, 389 bp, Homo sapiens
gcggccgcctactactactactactactactaaattcgcggccgctcgaggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301294 - DNA, 399 bp, Homo sapiens
gagagagagagagagagagagagagagagagagagagagagagagagtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301295 - DNA, 402 bp, Homo sapiens
  misc_feature (4)..(4): n is a, c, g, or t
  misc_feature (28)..(28): n is a, c, g, or t
cgangcttgatatcgaattcgcgccccntcgatacggctgcgagagacgacgaagggcgactggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301296 - DNA, 377 bp, Homo sapiens
  misc_feature (11)..(12): n is a, c, g, or t
  misc_feature (14)..(14): n is a, c, g, or t
tgggataggcnntnatttgcctaggtcgtttcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301297 - DNA, 388 bp, Homo sapiens
gaaaaaaactaggctagtacgggctggtgttaaatcaggccgaggcatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301298 - DNA, 615 bp, Homo sapiens
  misc_feature (17)..(17): n is a, c, g, or t
  misc_feature (454)..(454): n is a, c, g, or t
  misc_feature (461)..(461): n is a, c, g, or t
  misc_feature (464)..(464): n is a, c, g, or t
cgccgccgccgacacgngcgagaagacgacagaagggctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaaaaaaaaaacccgnggggagnctnataatggcgcgggggcgcggagaaaaagagggggaaagagaaaggggcacagagggggccacaagaggggtgtcccggggcacccagagttttctggggtcacaaaggggggcaaacgggggggcccccctaaagggggagggaataaatg

SEQ ID NO: 301299 - DNA, 1445 bp, Homo sapiens
  misc_feature (17)..(17): n is a, c, g, or t
agggcaaactcccagangattttaaccttggtccaagtccaagcaattttagaatcccctggtggtctagtggttagattcgggcgcttttcaccgccgcgggccgggttcgtttcccggtcagggaacccttcctttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaattgccttggcttgttaactttattagacattctgatgtttgcattgtgtaaatactgttgtattggaaaagcatgccaagatggattattgtaattcagtgtcttttttagtagtcaaatggtaaaatgcagcataagaatataagtcttccaagttagatatgagtgttagctttttataagtctgctcctgccagtttgactttgagatacattggagccaactgtaaactttagtttttaaattacagttagtttttttgtttgtttttgaggcggagtctctgttacccaggctggagtgcagtataccagtcttggcccacttcaacctccacttcttaggttcaagcgattctcctgcctcagctactttggaggctcaggcacaagaatcacttgaacctacgaggcggaggttgcagtgagccaggatcgtgccactgcactttatttagccaggacaacactctgtctccaaaaaaaagtttctgaaggtaaaagatatactaaaggatatacatatactgcctcttctatgatgtttcatttgacctacaccatcagcatcttcaggaaacagtatgaaactaatttcacattaaatgttgcaaacgtctgcaattctccagtttttagtttgcacgtaaggattcgtaggattgatttcagattgacagatggttgtagtaacaaaaaaatgaattgccttggagaattcgagttattttaggcctgcctttgacacttttatgcacttaattcactgccaatttagtctaactcctcaaccatctgtggtatggacttctcagtcctcctaattggtatgtcttttatctatcccagagtcagtagtcctttaaggatgcaaatttaattcgataagaatgtggatttacttcatctttaggacagagtaaaaacctttatttca

SEQ ID NO: 301300 - DNA, 758 bp, Homo sapiens
  misc_feature (477)..(477): n is a, c, g, or t
  misc_feature (487)..(487): n is a, c, g, or t
  misc_feature (682)..(682): n is a, c, g, or t
  misc_feature (700)..(700): n is a, c, g, or t
  misc_feature (703)..(703): n is a, c, g, or t
  misc_feature (705)..(705): n is a, c, g, or t
  misc_feature (711)..(711): n is a, c, g, or t
  misc_feature (716)..(716): n is a, c, g, or t
  misc_feature (729)..(729): n is a, c, g, or t
  misc_feature (732)..(732): n is a, c, g, or t
  misc_feature (734)..(734): n is a, c, g, or t
  misc_feature (740)..(740): n is a, c, g, or t
  misc_feature (744)..(744): n is a, c, g, or t
ccacgcgtcgggacgcgtgttcggacgcgtgggcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaattcgagactagttctctctctccaggggcctggggaaaaggacgggtcttcttcggccaaaatggtcngggatatggngaaataaaagagccagctgggagaacctgggacacctccaggcctccggagaagaagggcacgctgttgaagattcaggggaccacgggggaaccaataaggctaggaggggtctctccacgggagggaactagactttagaacactggcgaaaccaaaaatcgcaagctgggcagaactgtgggatcagcggcnggccattgaagatgaacntcngnggagcnctgtngaaacaccggcancgnangacggnccanggatgatgcctcac

SEQ ID NO: 301301 - DNA, 626 bp, Homo sapiens
  misc_feature (11)..(12): n is a, c, g, or t
  misc_feature (14)..(14): n is a, c, g, or t
  misc_feature (515)..(515): n is a, c, g, or t
  misc_feature (623)..(623): n is a, c, g, or t
tgggataggcnntnatttgcctaggtcgtttcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaaaaaaaaaacccggggggtttttgtgggggggggggaaaaagggggtaagagaaaggggccatggggccaaaaggcggggttccgggacccaaggttttcttgnggcgacaagggggggaaattcgggcggggtcccccataataaggggaggccggataataaattccgagaaaaacccggggtacccggggttaagacacgcagaaaaanagc

SEQ ID NO: 301302 - DNA, 651 bp, Homo sapiens
  misc_feature (1)..(1): n is a, c, g, or t
  misc_feature (404)..(404): n is a, c, g, or t
  misc_feature (430)..(430): n is a, c, g, or t
  misc_feature (432)..(432): n is a, c, g, or t
  misc_feature (438)..(438): n is a, c, g, or t
  misc_feature (442)..(442): n is a, c, g, or t
  misc_feature (450)..(450): n is a, c, g, or t
  misc_feature (491)..(491): n is a, c, g, or t
  misc_feature (517)..(517): n is a, c, g, or t
  misc_feature (525)..(525): n is a, c, g, or t
naagtataggctaggtacgaggctgggtggtcgctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaacccnggaaggcaaaaagggaaaaacaacantnaaaacngggngctccagngctgaacaattgggcagatgaacccatttgacagaggatcnggctttggcaatggggtcagagggcnttgggggncaaagcagagaagtaaagggaatgggcatggggtcgtagagctactaacgggattactcgacaggggaaaccctactatgaaagtatccttgtccatgaccaagggttatgcagggacggggtggc

SEQ ID NO: 301303 - DNA, 446 bp, Homo sapiens
  misc_feature (425)..(425): n is a, c, g, or t
gcggccgcctactactactaaattcgcggccgcgtcgacacgagaaggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaagtcgacgcggccgcgaatttagtagtagtagnctagtagtagtaggcggccgc

SEQ ID NO: 301304 - DNA, 313 bp, Homo sapiens
ccgcgtcgaccggagggaggccccatagcgggtcccgtatttaccgatgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301305 - DNA, 275 bp, Homo sapiens
ccccttcgagttcccgtccgaaattcgcggccgactactactactaaattcgcggccgcgtcgacaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301306 - DNA, 195 bp, Homo sapiens
ccccttcgagttcccgtccgaaattcgcggccgactactactactaaattcgcggccgcgtcgacctttaccgtgacagcggaagtggtaaagtccgccatcagaagactgaaggagttgaaagaccagtagacgctcctctactctttgagacatcactggcctataataaatgggttaatttatgtaacaaaa

SEQ ID NO: 301307 - DNA, 2273 bp, Homo sapiens
cgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaagtaagtaaggcaaagtctctggtgagaggagagggagggcaggtttcttacccaagtgaggcctgacttcaaggtattttataagccgtgtgctggtgggcagttggaattactcataccgttgattatgagttttaagataaaagtgttgatggtaacttcagattttgtgagacgtttttcatttaaagaaaaccgcttaaacgttaatgggtaaaataatcatttgacagagtgcccccagcctaagccaaacctgctttgtgggaaatgattccatcagttttgtctactgatgtttctgcaccaactcccaaaatgtctgtgcatctaataccattctacttgttctgcgagggatttttgtttgataaaggtttgaacgtttatgtgcaaaatactgcattacagcaatccttgttttgtttttgagggagaaagggaggctttcacatccctgacaataaggtgaatccaaatttagacttctggatgcttgtaagagaaaatacttacttggttcatagtgaaaattggttctcttttatagaccaagatgaagagacgagctgtggggatctggcactgtggttcctgcatgaagacagtggctggcggtgcctggacgtacaaagtgagtctagttccttgtggtatttggaagtgtgtggaccacataggcccaaattccaggttgctgctggatgggctagttttaacactttctcaggactgagagaataaggatgcctttgtattttcaggattcttccgtggtggtttattttcagttattgaaagagtaaacacaaaactaccaaaatagaagtcggaaatctaattcacagactactttagaatttgatggtcactgggcacattgttgtgaacattgtcatgatactgtgcaggtccattagtggggctgaatctactgaacgttgatttgcactgcaagttttgataaaaataggtgaaggggtcagttagttcaaaactgtatttggaacttgaggccatcaggaccaccacagtttcgtctttctgaacagtattagactgctgcaggtttgtgaatctgcaactcagtatcacctgacagggcgatactacaaacactatactacaaactagcatctagacctgtgttgtccaatacactaagcacatatatggctagtgtaattaaagaattggattttaaagtttcagtcaatttaaacttaaaccgaagcagtggaaaatgttgaaatatatatatattccttgtgggggtttttattagggcagaatggaaaatgggaactagagtgctttcttggttctgataggaaagtgaattatttatatacttacaatacaggatggtgattttcaggtatagttcctgaattttatggtaaaacttttgtagtcatttcaatagctgtctttcccaaaggcactttagtgtccgctcttatttccttaatcattgttctcactgtatcatcttgtaatttattcatttcttgtaatctgtccattcccttttaataagtttaggtcagcctcttagaaccatttctttttcatgggatggggtagggggagttaaagcttgcttgtccacaactgagttacttataaaaaaaaaagcaactctggttgagaaatcagatgcatgagattgtatgtctaattctgcaagatcctgaaggcatggctcttaaaggatgccatcatgtagtttagaagccactaatttccgaggagtaatctaatgttggttagatctttggattgactgcagcaaagtattggtagagcagtctatctcagtataattctttctaggaaaatttgggaagcgactttaacacaaaaacgaggcagatttacttatttgccattttctatgttaacatgcttaattatgttggaaactgaatctttctttccagtaccacttccgctgtcacggtaaagtccgccatcagaagactgaaggagttgaaagaccagtagacgctcctctactctttgagacatcactggcctataataaatgggttaatttatgtaacaaaa

SEQ ID NO: 301308 - DNA, 715 bp, Homo sapiens
  misc_feature (604)..(604): n is a, c, g, or t
  misc_feature (712)..(712): n is a, c, g, or t
cgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaacatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaacaaaaaaaaaaaaaaaaaaaaaaaaaaaaaaaaaaaaaagccggggggcccggggggtttttgtgggggggggggaaaaagggggtaagagaaaggggccatggggccaaaaggcggggttccgggacccaaggttttcttgnggcgacaagggggggaaattcgggcggggtcccccataataaggggaggccggataataaattccgagaaaaacccggggtacccggggttaagacacgcagaaaaanagc

SEQ ID NO: 301309 - DNA, 572 bp, Homo sapiens
  misc_feature (32)..(32): n is a, c, g, or t
  misc_feature (388)..(388): n is a, c, g, or t
  misc_feature (411)..(411): n is a, c, g, or t
  misc_feature (459)..(459): n is a, c, g, or t
  misc_feature (477)..(478): n is a, c, g, or t
  misc_feature (488)..(488): n is a, c, g, or t
  misc_feature (495)..(495): n is a, c, g, or t
  misc_feature (508)..(508): n is a, c, g, or t
  misc_feature (517)..(517): n is a, c, g, or t
  misc_feature (548)..(548): n is a, c, g, or t
tcggatccaacgttggatccgaattcggcacnagccggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaatnaaaaaaaaaaacttcgaaggggnggggccccggtaccccaatttcggcccctattaggtgaagtccgtatnacaaatttaacttggccnntcggttttanaaccgtnggttgacttgggnaaaaccctngggggttacccaactttaattcgccttttgnaggaaaatccccccttttggccag

SEQ ID NO: 301310 - DNA, 384 bp, Homo sapiens
  misc_feature (32)..(32): n is a, c, g, or t
tcggatccaacgttggatccgaattcggcacnagccggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301311 - DNA, 308 bp, Homo sapiens
  misc_feature (197)..(197): n is a, c, g, or t
  misc_feature (240)..(240): n is a, c, g, or t
acgtttgccagattgacgggttgacggatgaagcagatagtgaggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgcngtcacggtaaaggccgcctccgggccattcaacgcctccgggncattcaacgcctccgggccattcaacgcctccgggccattcaacgcctccgggccattcaacgcctcc

SEQ ID NO: 301312 - DNA, 290 bp, Homo sapiens
actagttctctctctctctctctgtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301313 - DNA, 186 bp, Homo sapiens
ccacgtagagctgggaatctgcactgtgtcgaaagtgctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301314 - DNA, 394 bp, Homo sapiens
aaaaaaaaaaaaaaaacttttttttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301315 - DNA, 435 bp, Homo sapiens
  misc_feature (414)..(414): n is a, c, g, or t
cgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcacaaaaaaagtcgacgcggccgcgaatttagtagtagtagnctagtagtagtaggcggccgc

SEQ ID NO: 301316 - DNA, 459 bp, Homo sapiens
ttcagaagttgtagctccactgtatcccgcaggtgcttccattttagccccgggggcttatagaccgcgaaaagcccatgcagccgcgacaagccagcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301317 - DNA, 730 bp, Homo sapiens
  misc_feature (18)..(18): n is a, c, g, or t
ggcaaccacagccggaanttacggctaggtacgaggcctgggtggtgcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaataaaaaaaaaaaaaaaaaaaaaaaaaaaaaaaaaaaaaaaaaaaaaaaaaaaagccggggggtctttttttgggggggcggaaaaaaggggttaaaaagggggaaggtggtgccgcatacggttgtcttctgcagaccccccgttttttcgtgcgacagagggggataatatatctcggggggtcccccccatgaggagggggacgagtaatatatctagtgaaaaccggcgggttaaccgttttttgttttagttggagagaaataatataatagcgtgcagatgcgatggaacaagagtgcagtgcatggatggaggacacgagt

SEQ ID NO: 301318 - DNA, 398 bp, Homo sapiens
  misc_feature (18)..(18): n is a, c, g, or t
ggcaaccacagccggaanttacggctaggtacgaggcctgggtggtgcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301319 - DNA, 935 bp, Homo sapiens
  misc_feature (18)..(18): n is a, c, g, or t
ggcaaccacagccggaanttacggctaggtacgaggcctgggtggtgcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaataaaaaaaaaaaaaaaaaaaaaaaaaaaaaaaaaaaaaaaaaaaaaaaaaagccggggggccccttttcgcgggggggcgggaaaaagaggggaagagaggggcgcccggggccacgggtcccggacccccgttttggggccccggggggacacacggggggagccccccaaaaggggggccggggactaatcaacaaaaacgccaggagaacacctgagttatatgatgttcggtaaggcaggacgatctacacgccgacggaagaaggcagagcggaggcaccatggagggacgccaccaacagcctcacacgccagcagccgcatgctatgcagccgaggagagacagcggctgagccagcaaaacaacaaaacacgccgccggcaagaccgcggagaagtctcagaaggccgaccgacaacacgcacacaacccccacacgggcaacggccacacagaggcgaacacaacgggagacaagcacagacaaggggcaaacagtggacagccagaaccgcagacagcagag

SEQ ID NO: 301320 - DNA, 1401 bp, Homo sapiens
cgggacctgtgtgcatggccaacgtcttgtcgtgttgtcccagtgttgaggcagaccagttctcaggtgagccatgtgcgtcacccagggctctacccacagtagcgtgaatgtgcctcccctggcgacgctgttgaaagttgggaagatttctggagtcccccaacgtcggttgacggtgggtgcccaaagacccagtcagggtcaccaaggggacagccaatattcggaggccatgcccgacatttcgaaagacaccagcgaagttaccagaagtatacggtggcccccgagtgacgacttgaatgttagccccctttctcttctgagagtatttctggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaacaaaaaaaaaaaaaaaaaaaaaaaaaactcagagggccatcatatgtcggggtcgcgcgagaaaacagagagggtacttggacatggcgcaccaggggtcatagggtggtatcccttgacccaggtttccttggtaccaaaggtgggaaaaatcttcgccgggtcttccccttataggtagagccgcaattaacatttcgcgaaataagcccgggttttacccccgtgcatttagtgtgaaacgtcgcgaaaaaaaacagcaacgacgcaacaagcgacagaagacacacgacgacaacagccagaaccagaaacaagcgacgggacacacgacgacacaaatatggaagaacaacacaaccatagagagagacaagaaaaacacagcagctaaataacaagagtgaaaaaaaaacaaaaaaaagatggaaagaagacaacaacaaaaagaaacacacaagaaagattagcaaggcgacatacagaaacaaaaagtagaaaaaagagagcaagacaagacaagagaaaacaagggaaaaagcaacacgaaagctggcaaaacaagacgagagagaaacagacaaagagaagagaagagaagaaagaaaagagaagagaagaaagaaggcaaaacgaagaaggacgaagcaagagaagcaggaggaccaggaggaaagaa

SEQ ID NO: 301321 - DNA, 733 bp, Homo sapiens
  misc_feature (452)..(452): n is a, c, g, or t
  misc_feature (462)..(462): n is a, c, g, or t
  misc_feature (657)..(657): n is a, c, g, or t
  misc_feature (675)..(675): n is a, c, g, or t
  misc_feature (678)..(678): n is a, c, g, or t
  misc_feature (680)..(680): n is a, c, g, or t
  misc_feature (686)..(686): n is a, c, g, or t
  misc_feature (691)..(691): n is a, c, g, or t
  misc_feature (704)..(704): n is a, c, g, or t
  misc_feature (707)..(707): n is a, c, g, or t
  misc_feature (709)..(709): n is a, c, g, or t
  misc_feature (715)..(715): n is a, c, g, or t
  misc_feature (719)..(719): n is a, c, g, or t
tcggcacgaggactaggctccgcgggtaatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaattcgagactagttctctctctccaggggcctggggaaaaggacgggtcttcttcggccaaaatggtcngggatatggngaaataaaagagccagctgggagaacctgggacacctccaggcctccggagaagaagggcacgctgttgaagattcaggggaccacgggggaaccaataaggctaggaggggtctctccacgggagggaactagactttagaacactggcgaaaccaaaaatcgcaagctgggcagaactgtgggatcagcggcnggccattgaagatgaacntcngnggagcnctgtngaaacaccggcancgnangacggnccanggatgatgcctcac

SEQ ID NO: 301322 - DNA, 719 bp, Homo sapiens
  misc_feature (451)..(451): n is a, c, g, or t
cgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaatttttgggccggccngggccctcgaaaaagttttttaaaaccattcggttggggccggccgggccccaagaaaggttattgctgaaacagtgtggtccaaagcggtgttcccaaggagaaaactccggggacatgtgcacatagcgtccttgtggttctcttccccaatttaaaaaaacgcccgcggcgaaaccagcgcttgtgtgaacacattccgaagggagtcgagaggcacatagggggcttattcacgggcgtcccaagagccgacaattaatacccg

SEQ ID NO: 301323 - DNA, 686 bp, Homo sapiens
  misc_feature (655)..(655): n is a, c, g, or t
aaaaaaaaaaaaaaaacttttttttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaagggcagccgctcgcatctagaactataattttaataatcaacaccctcctagccttactactaataattattacattttgggactaccacaactcaacggctacttagaaaaatccaccccttacgagtgcggtttcgaccctattatcccccgcccgggtccctttctccataaaattcttcttagtagctattaccttcttattattggatctagaaattgccctcctttttaccccttaccatgagccctnaaaaaattaacctgccactaatagttatgtc

SEQ ID NO: 301324 - DNA, 654 bp, Homo sapiens
  misc_feature (543)..(543): n is a, c, g, or t
  misc_feature (651)..(651): n is a, c, g, or t
cgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaaaccccggggggtttttgtgggggggggggaaaaagggggtaagagaaaggggccatggggccaaaaggcggggttccgggacccaaggttttcttgnggcgacaagggggggaaattcgggcggggtcccccataataaggggaggccggataataaattccgagaaaaacccggggtacccggggttaagacacgcagaaaaanagc

SEQ ID NO: 301325 - DNA, 1081 bp, Homo sapiens
cgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaactcagagggccatcatatgtcggggtcgcgcgagaaaacagagagggtacttggacatggcgcaccaggggtcatagggtggtatcccttgacccaggtttccttggtaccaaaggtgggaaaaatcttcgccgggtcttccccttataggtagagccgcaattaacatttcgcgaaataagcccgggttttacccccgtgcatttagtgtgaaacgtcgcgaaaaaaaacagcaacgacgcaacaagcgacagaagacacacgacgacaacagccagaaccagaaacaagcgacgggacacacgacgacacaaatatggaagaacaacacaaccatagagagagacaagaaaaacacagcagctaaataacaagagtgaaaaaaaaacaaaaaaaagatggaaagaagacaacaacaaaaagaaacacacaagaaagattagcaaggcgacatacagaaacaaaaagtagaaaaaagagagcaagacaagacaagagaaaacaagggaaaaagcaacacgaaagctggcaaaacaagacgagagagaaacagacaaagagaagagaagagaagaaagaaaagagaagagaagaaagaaggcaaaacgaagaaggacgaagcaagagaagcaggaggaccaggaggaaagaa

SEQ ID NO: 301326 - DNA, 411 bp, Homo sapiens
cgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301327 - DNA, 177 bp, Homo sapiens
gaggagaaggagtgaacaaaatcacgcccgcaatgaaaacaaaaactcagtaccacttccgctgtcacggtaaagtccgccatcagaagactgaaggagttgaaagaccagtagacgctcctctactctttgagacatcactggcctataataaatgggttaatttatgtaacaaaa

SEQ ID NO: 301328 - DNA, 547 bp, Homo sapiens
ggttctgcgtttgactaagctggtggtggatagtcacgtgcagtatcggctgggcaatgtggatgccttccagctggcagatggattgcagtatatatttgcccatgttgggcagttgacgggcatgtatcgatacaaatacaagctgatgcgacagattcgcatgtgcaaggacctgaagcatctcatctattatcgtttcaacacggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301329 - DNA, 380 bp, Homo sapiens
ggacggcgtgggtcgacccacgcgtcggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301330 - DNA, 867 bp, Homo sapiens
cgttgaatggcccggaggcgttgaatggcccggaggcgttgaatggccaaacgtaccaagaaagtcgggatcgtcggtaaatacgggacccgctatggggcctccctccggaaaatggtgaagaaaattgaaatcagccagcacgccaagtacacttgctctttctgtggcaaaggctgaggcaggtggattacttgaggccaggagattgagaccagtgtggccaacatagcaaaaacccgtctcgacgaaaaatacagaaaatagcttggtatggtggcacgtgcctgtagtcccagctactttggaggctcaggcacaagaatcacttgaacctacgaggcggaggttgcagtgagccaggatcgtgccactgcactttatttagccaggacaacactctgtctccaaaaaaaagtttctgaaggtaaaagatatactaaaggatatacatatactgcctcttctatgatgtttcatttgacctacaccatcagcatcttcaggaaacagtatgaaactaatttcacattaaatgttgcaaacgtctgcaattctccagtttttagtttgcacgtaaggattcgtaggattgatttcagattgacagatggttgtagtaacaaaaaaatgaattgccttggagaattcgagttattttaggcctgcctttgacacttttatgcacttaattcactgccaatttagtctaactcctcaaccatctgtggtatggacttctcagtcctcctaattggtatgtcttttatctatcccagagtcagtagtcctttaaggatgcaaatttaattcgataagaatgtggatttacttcatctttaggacagagtaaaaacctttatttca

SEQ ID NO: 301331 - DNA, 634 bp, Homo sapiens
  misc_feature (587)..(587): n is a, c, g, or t
  misc_feature (607)..(607): n is a, c, g, or t
  misc_feature (624)..(624): n is a, c, g, or t
cgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaattgccttggcttgttaactttattagacattctgatgtttgcattgtgtaaatactgttgtattggaaaagcatgccaagatggattattgtaattcagtgtcttttttagtagtcaaatggtaaaatgcagcataagaatataagtcttccaagttaaaaaaaaaagaacaagnccaaaacgcccataaaaaanggccacatgtgctcganctgcaggtcg

SEQ ID NO: 301332 - DNA, 442 bp, Homo sapiens
  misc_feature (71)..(71): n is a, c, g, or t
gcggccgcctactactactaaattcgcggccgcgtcgacacgagaagacgacagaaggggctttctgggcncggcgacatcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301333 - DNA, 420 bp, Homo sapiens
  misc_feature (71)..(71): n is a, c, g, or t
gcggccgcctactactactaaattcgcggccgcgtcgacacgagaagacgacagaaggggctttctgggcncggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301334 - DNA, 624 bp, Homo sapiens
  misc_feature (513)..(513): n is a, c, g, or t
  misc_feature (523)..(523): n is a, c, g, or t
  misc_feature (540)..(540): n is a, c, g, or t
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaaaaaaaaaaaaaaaaaaaaaaaaaaaaaaaaaaaaaaaaagagagagggggnggcgcgcgcnaacaaagaccacacccnggaggggcgccccacacgcagccgccgcgccccctcttttagtgaagcaagggggcgcccccaaaaggggggggcgataaatag

SEQ ID NO: 301335 - DNA, 963 bp, Homo sapiens
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaaaaaaaaaaaaaaaaaaaaaaaaaaaaaaaaaaaggagggggggcgcgcccccacaaaataccccccgcggggggcgcccacaagagaacgagccacccgcgtattattcgaaaaagagagggggccccaataagagagggaggcgaaataataaaaacacgaagcgagagcggacgcgacgaaataaacaaaagagtagagaggaggagagacaaacaggacacagcagaggtacaatgagagagagaagaccacaatcggcggggagggggagaaacaacaatgatggggggcgaacaaaaccccactgaagaaaattatttaaaggcactgatgaggagagaacaaaataaataacattgggcaggggttgttaatgagtgtgaaccaacaagcagacatagtatgtgatgtgccgcatcaaaaaaaactatctggtaaaaccagagttatgttttagaaaaaaattttaaacgcaggggaggggttaaatgaaatggg

SEQ ID NO: 301336 - DNA, 1212 bp, Homo sapiens
  misc_feature (1212)..(1212): n is a, c, g, or t
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaagccgggggggggggccaataaaacccccggggggggccccctcgccccccctttttttgcaaacagggtggcccctaatagggtagggctattaaatagacgcgagggacgggggaggcatttaaaaaccaatggtgaggacaggtgaaaaaacgatgatagatgtcggagcatctggagggaaggcacagccaattagtggtgttgcgggtccactatacgggggcaccaccatgtccgaagaagatttatagagcgccgataggacaaatcaaaaagtaagcgtgtatattggtgataaccaagatcgtatatgctgtggttagaagacctgtgggcaccgcgggttagtgctttagaacacatctaacgggctcggacgtagacaccgagcggcagagtcactaagacaaacagcaagcaaagagcacggcacggagcacgcgagtctcagcgacaaacacggagacgaaccacacaacaagccatcagacacggaagcgctaaccacaagaacgcagcagaaccagacaacatgactagcaggagagcagaggatcaacgacgtacgaaccagcaagctagacacatggcaaggacatagatcgatgccgccgccacn

SEQ ID NO: 301337 - DNA, 603 bp, Homo sapiens
  misc_feature (17)..(17): n is a, c, g, or t
  misc_feature (492)..(492): n is a, c, g, or t
  misc_feature (502)..(502): n is a, c, g, or t
  misc_feature (519)..(519): n is a, c, g, or t
cgccgccgccgacacgngcgagaagacgacagaagggctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaaaaaaaaaaaaaaaaaaaaaaaaaaaaaaaaaaaaaaaaagagagagggggnggcgcgcgcnaacaaagaccacacccnggaggggcgccccacacgcagccgccgcgccccctcttttagtgaagcaagggggcgcccccaaaaggggggggcgataaatag

SEQ ID NO: 301338 - DNA, 587 bp, Homo sapiens
  misc_feature (476)..(476): n is a, c, g, or t
  misc_feature (486)..(486): n is a, c, g, or t
  misc_feature (503)..(503): n is a, c, g, or t
tactactaagttcgcggcagctacaaaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaaaaaaaaaaaaaaaaaaaaaaaaaaaaaaaaaaaaaaaaagagagagggggnggcgcgcgcnaacaaagaccacacccnggaggggcgccccacacgcagccgccgcgccccctcttttagtgaagcaagggggcgcccccaaaaggggggggcgataaatag

SEQ ID NO: 301339 - DNA, 636 bp, Homo sapiens
  misc_feature (475)..(475): n is a, c, g, or t
  misc_feature (482)..(482): n is a, c, g, or t
  misc_feature (485)..(485): n is a, c, g, or t
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaaaaaaaaaacccgnggggagnctnataatggcgcgggggcgcggagaaaaagagggggaaagagaaaggggcacagagggggccacaagaggggtgtcccggggcacccagagttttctggggtcacaaaggggggcaaacgggggggcccccctaaagggggagggaataaatg

SEQ ID NO: 301340 - DNA, 676 bp, Homo sapiens
  misc_feature (565)..(565): n is a, c, g, or t
  misc_feature (673)..(673): n is a, c, g, or t
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaaaaaaaaaacccggggggtttttgtgggggggggggaaaaagggggtaagagaaaggggccatggggccaaaaggcggggttccgggacccaaggttttcttgnggcgacaagggggggaaattcgggcggggtcccccataataaggggaggccggataataaattccgagaaaaacccggggtacccggggttaagacacgcagaaaaanagc

SEQ ID NO: 301341 - DNA, 1187 bp, Homo sapiens
  misc_feature (1187)..(1187): n is a, c, g, or t
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaagccgggggggggggccaataaaacccccggggggggccccctcgccccccctttttttgcaaacagggtggcccctaatagggtagggctattaaatagacgcgagggacgggggaggcatttaaaaaccaatggtgaggacaggtgaaaaaacgatgatagatgtcggagcatctggagggaaggcacagccaattagtggtgttgcgggtccactatacgggggcaccaccatgtccgaagaagatttatagagcgccgataggacaaatcaaaaagtaagcgtgtatattggtgataaccaagatcgtatatgctgtggttagaagacctgtgggcaccgcgggttagtgctttagaacacatctaacgggctcggacgtagacaccgagcggcagagtcactaagacaaacagcaagcaaagagcacggcacggagcacgcgagtctcagcgacaaacacggagacgaaccacacaacaagccatcagacacggaagcgctaaccacaagaacgcagcagaaccagacaacatgactagcaggagagcagaggatcaacgacgtacgaaccagcaagctagacacatggcaaggacatagatcgatgccgccgccacn

SEQ ID NO: 301342 - DNA, 1742 bp, Homo sapiens
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaattgccttggcttgttaactttattagacattctgatgtttgcattgtgtaaatactgttgtattggaaaagcatgccaagatggattattgtaattcagtgtcttttttagtagtcaaatggtaaaatgcagcataagaatataagtcttccaagttagatatgagtgttagctttttataagtctgctcctgccagtttgactttgagatacattggagccaactgtaaactttagtttttaaattacagttagtttttttgtttgtttttgaggcggagtctctgttacccaggctggagtgcagtataccagtcttggcccacttcaacctccacttcttaggttcaagcgattctcctgcctcagcctcctgagtagctgggattgcaggcacgcaccaccatacctggctaatttttgtattttgagtagagatggagttttcaccacattggccaggctgttcttgaactgacctcaagcgatccacctgccttggccttccagagtgctgggattgcaggtgtgggccaccacgcccagccttgcatttaatatttttataatgtgtctaggctgggtgcggtgactcacgcctgaaatcccagcactttgggtggctgaggcaggtggattacttgaggccaggagattgagaccagtgtggccaacatagcaaaaacccgtctcgacgaaaaatacagaaaatagcttggtatggtggcacgtgcctgtagtcccagctactttggaggctcaggcacaagaatcacttgaacctacgaggcggaggttgcagtgagccaggatcgtgccactgcactttatttagccaggacaacactctgtctccaaaaaaaagtttctgaaggtaaaagatatactaaaggatatacatatactgcctcttctatgatgtttcatttgacctacaccatcagcatcttcaggaaacagtatgaaactaatttcacattaaatgttgcaaacgtctgcaattctccagtttttagtttgcacgtaaggattcgtaggattgatttcagattgacagatggttgtagtaacaaaaaaatgaattgccttggagaattcgagttattttaggcctgcctttgacacttttatgcacttaattcactgccaatttagtctaactcctcaaccatctgtggtatggacttctcagtcctcctaattggtatgtcttttatctatcccagagtcagtagtcctttaaggatgcaaatttaattcgataagaatgtggatttacttcatctttaggacagagtaaaaacctttatttca

SEQ ID NO: 301343 - DNA, 1822 bp, Homo sapiens
  misc_feature (17)..(17): n is a, c, g, or t
agggcaaactcccagangattttaaccttggtccaagtccaagcaattttagaatcccctggtggtctagtggttagattcgggcgcttttcaccgccgcgggccgggttcgtttcccggtcagggaacccttcctttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaattgccttggcttgttaactttattagacattctgatgtttgcattgtgtaaatactgttgtattggaaaagcatgccaagatggattattgtaattcagtgtcttttttagtagtcaaatggtaaaatgcagcataagaatataagtcttccaagttagatatgagtgttagctttttataagtctgctcctgccagtttgactttgagatacattggagccaactgtaaactttagtttttaaattacagttagtttttttgtttgtttttgaggcggagtctctgttacccaggctggagtgcagtataccagtcttggcccacttcaacctccacttcttaggttcaagcgattctcctgcctcagcctcctgagtagctgggattgcaggcacgcaccaccatacctggctaatttttgtattttgagtagagatggagttttcaccacattggccaggctgttcttgaactgacctcaagcgatccacctgccttggccttccagagtgctgggattgcaggtgtgggccaccacgcccagccttgcatttaatatttttataatgtgtctaggctgggtgcggtgactcacgcctgaaatcccagcactttgggtggctgaggcaggtggattacttgaggccaggagattgagaccagtgtggccaacatagcaaaaacccgtctcgacgaaaaatacagaaaatagcttggtatggtggcacgtgcctgtagtcccagctactttggaggctcaggcacaagaatcacttgaacctacgaggcggaggttgcagtgagccaggatcgtgccactgcactttatttagccaggacaacactctgtctccaaaaaaaagtttctgaaggtaaaagatatactaaaggatatacatatactgcctcttctatgatgtttcatttgacctacaccatcagcatcttcaggaaacagtatgaaactaatttcacattaaatgttgcaaacgtctgcaattctccagtttttagtttgcacgtaaggattcgtaggattgatttcagattgacagatggttgtagtaacaaaaaaatgaattgccttggagaattcgagttattttaggcctgcctttgacacttttatgcacttaattcactgccaatttagtctaactcctcaaccatctgtggtatggacttctcagtcctcctaattggtatgtcttttatctatcccagagtcagtagtcctttaaggatgcaaatttaattcgataagaatgtggatttacttcatctttaggacagagtaaaaacctttatttca

SEQ ID NO: 301344 - DNA, 1365 bp, Homo sapiens
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaattgccttggcttgttaactttattagacattctgatgtttgcattgtgtaaatactgttgtattggaaaagcatgccaagatggattattgtaattcagtgtcttttttagtagtcaaatggtaaaatgcagcataagaatataagtcttccaagttagatatgagtgttagctttttataagtctgctcctgccagtttgactttgagatacattggagccaactgtaaactttagtttttaaattacagttagtttttttgtttgtttttgaggcggagtctctgttacccaggctggagtgcagtataccagtcttggcccacttcaacctccacttcttaggttcaagcgattctcctgcctcagctactttggaggctcaggcacaagaatcacttgaacctacgaggcggaggttgcagtgagccaggatcgtgccactgcactttatttagccaggacaacactctgtctccaaaaaaaagtttctgaaggtaaaagatatactaaaggatatacatatactgcctcttctatgatgtttcatttgacctacaccatcagcatcttcaggaaacagtatgaaactaatttcacattaaatgttgcaaacgtctgcaattctccagtttttagtttgcacgtaaggattcgtaggattgatttcagattgacagatggttgtagtaacaaaaaaatgaattgccttggagaattcgagttattttaggcctgcctttgacacttttatgcacttaattcactgccaatttagtctaactcctcaaccatctgtggtatggacttctcagtcctcctaattggtatgtcttttatctatcccagagtcagtagtcctttaaggatgcaaatttaattcgataagaatgtggatttacttcatctttaggacagagtaaaaacctttatttca

SEQ ID NO: 301345 - DNA, 1303 bp, Homo sapiens
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaattgccttggcttgttaactttattagacattctgatgtttgcattgtgtaaatactgttgtattggaaaagcatgccaagatggattattgtaattcagtgtcttttttagtagtcaaatggtaaaatgcagcataagaatataagtcttccaagttagatatgagtgttagctttttataagtctgctcctgccagtttgactttgagatacattggagccaactgtaaactttagtttttaaattacagttagtttttttgtttgtttttgaggcggagtctctgttacccaggctggagtgcagtataccagtcttggcccacttcaacctccattgaacctacgaggcggaggttgcagtgagccaggatcgtgccactgcactttatttagccaggacaacactctgtctccaaaaaaaagtttctgaaggtaaaagatatactaaaggatatacatatactgcctcttctatgatgtttcatttgacctacaccatcagcatcttcaggaaacagtatgaaactaatttcacattaaatgttgcaaacgtctgcaattctccagtttttagtttgcacgtaaggattcgtaggattgatttcagattgacagatggttgtagtaacaaaaaaatgaattgccttggagaattcgagttattttaggcctgcctttgacacttttatgcacttaattcactgccaatttagtctaactcctcaaccatctgtggtatggacttctcagtcctcctaattggtatgtcttttatctatcccagagtcagtagtcctttaaggatgcaaatttaattcgataagaatgtggatttacttcatctttaggacagagtaaaaacctttatttca

SEQ ID NO: 301346 - DNA, 790 bp, Homo sapiens
  misc_feature (509)..(509): n is a, c, g, or t
  misc_feature (519)..(519): n is a, c, g, or t
  misc_feature (714)..(714): n is a, c, g, or t
  misc_feature (732)..(732): n is a, c, g, or t
  misc_feature (735)..(735): n is a, c, g, or t
  misc_feature (737)..(737): n is a, c, g, or t
  misc_feature (743)..(743): n is a, c, g, or t
  misc_feature (748)..(748): n is a, c, g, or t
  misc_feature (761)..(761): n is a, c, g, or t
  misc_feature (764)..(764): n is a, c, g, or t
  misc_feature (766)..(766): n is a, c, g, or t
  misc_feature (772)..(772): n is a, c, g, or t
  misc_feature (776)..(776): n is a, c, g, or t
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaattcgagactagttctctctctccaggggcctggggaaaaggacgggtcttcttcggccaaaatggtcngggatatggngaaataaaagagccagctgggagaacctgggacacctccaggcctccggagaagaagggcacgctgttgaagattcaggggaccacgggggaaccaataaggctaggaggggtctctccacgggagggaactagactttagaacactggcgaaaccaaaaatcgcaagctgggcagaactgtgggatcagcggcnggccattgaagatgaacntcngnggagcnctgtngaaacaccggcancgnangacggnccanggatgatgcctcac

SEQ ID NO: 301347 - DNA, 1114 bp, Homo sapiens
  misc_feature (1114)..(1114): n is a, c, g, or t
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaaaaaaaaaaaaaaaaaaaaaaaaaaaaaaaagccgggggggggggccaataaaacccccggggggggccccctcgccccccctttttttgcaaacagggtggcccctaatagggtagggctattaaatagacgcgagggacgggggaggcatttaaaaaccaatggtgaggacaggtgaaaaaacgatgatagatgtcggagcatctggagggaaggcacagccaattagtggtgttgcgggtccactatacgggggcaccaccatgtccgaagaagatttatagagcgccgataggacaaatcaaaaagtaagcgtgtatattggtgataaccaagatcgtatatgctgtggttagaagacctgtgggcaccgcgggttagtgctttagaacacatctaacgggctcggacgtagacaccgagcggcagagtcactaagacaaacagcaagcaaagagcacggcacggagcacgcgagtctcagcgacaaacacggagacgaaccacacaacaagccatcagacacggaagcgctaaccacaagaacgcagcagaaccagacaacatgactagcaggagagcagaggatcaacgacgtacgaaccagcaagctagacacatggcaaggacatagatcgatgccgccgccacn

SEQ ID NO: 301348 - DNA, 487 bp, Homo sapiens
  misc_feature (466)..(466): n is a, c, g, or t
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaagtcgacgcggccgcgaatttagtagtagtagnctagtagtagtaggcggccgc

SEQ ID NO: 301349 - DNA, 715 bp, Homo sapiens
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaacacactcaacccctccctcctcacctccttccaggaaatacctccctcccctacacacaaccatgccgcccgcctgggccaagtcgattttagattcgggcaggtttatgcatgcggccgaatttcgggttaacttgcccatttcgcctatagcgggccgctttacaattcactggtcgccgttttacaacggcgtgactgtgaaacccctggcgttacccaatttcgcctttgaggacaatcccctttccccagcttggcgctcagccacaggccccccccggccg

SEQ ID NO: 301350 - DNA, 641 bp, Homo sapiens
  misc_feature (466)..(467): n is a, c, g, or t
  misc_feature (469)..(469): n is a, c, g, or t
  misc_feature (476)..(477): n is a, c, g, or t
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaccccggggccnntnttttgcnngggggcgggaacacagggggtatgtgaaggggcccgttggctcattagcgtgttccctgtgccccagtttccttggttccaagggggtaaactcggcgggtcccccttatagggagccgattaaattccgataagcccggggtaccggctatggtccgcgcaat

SEQ ID NO: 301351 - DNA, 719 bp, Homo sapiens
  misc_feature (688)..(688): n is a, c, g, or t
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaagggcagccgctcgcatctagaactataattttaataatcaacaccctcctagccttactactaataattattacattttgggactaccacaactcaacggctacttagaaaaatccaccccttacgagtgcggtttcgaccctattatcccccgcccgggtccctttctccataaaattcttcttagtagctattaccttcttattattggatctagaaattgccctcctttttaccccttaccatgagccctnaaaaaattaacctgccactaatagttatgtc

SEQ ID NO: 301352 - DNA, 665 bp, Homo sapiens
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaacacaccggcggcgcctctcttttcccgcggcgggcgacacaacagaagcggtactaacaaacgtagacagtgaggccaataacgtgttcctcaggtcccaagaatttagtggttacccacggggcaacactgggcggccccccataaagagggcgaacaataaatccactaaccccgggtcaccgggtatagaaaacagaaac

SEQ ID NO: 301353 - DNA, 1071 bp, Homo sapiens
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaactcggaattatttcctcctctttttcttccctggggccgaatttcggcacgagggaattttcttctcaggatttaaaaaaaaaatcggggggtggctaggatcccactcttcagatacgggagacactacaagggcagtatccccatcattcttctggtacgggatgcaggtttctccagcgggatttctggagctgatgggacataactaagcttaacgggggaatttggctgacccatttaaacttggcagagtgcaacttggcaatattcatggggccggtatatcagaccctatatgggtggcaaacccttggcgcaagatactcttgcagaaacgaattgcttcgacgctgtgcgttggagctcctcggataaaagggtgccctaggctcaagatgtcctcctgggcaattttggtggacaccacgcttctcctttagattatgggcaggtttcaacagcggttcgccttgacggaggtgggtcgaaatacgaccgaggaatgggcctctaacacaaaattgaccgggcaaccggcctttgaaaagggaaccggcttggactcttgaatgtgccccgatgggggaactcgggggggaggcacatgcgcaacggttatagaagtgc

SEQ ID NO: 301354 - DNA, 913 bp, Homo sapiens
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaaaaaaaacaaaacaacaaaaaaaaacaaaaaagcgcagaagaagacaaacaaaaaaaacaagaaacaagaaaagagccaacacacgaacgaaaacaacgaacagagagcagcagaggagcggggggcggcgcagtaaagacgataacacagaaggaggaaagacaaaaaggagaacacacaaccaaaaagagaagaggaaaagaagagacccgacaacaaaagacacgaaaaatccacaagaagaaaagacacagacagacgaaaaggacaaagagacgaagagagaaagaaaaaacagaccaccagaagcaggaaacgaggaaagaaaaaaaaacaaagagaaggcagaggagcaaacgaggaaaaaacacaaacagaaagaaagaggagccaaaaagcgaaaaagacaaaaaacagagaagtgaaggacaacaagacagaagaaaagaaa

SEQ ID NO: 301355 - DNA, 795 bp, Homo sapiens
  misc_feature (509)..(509): n is a, c, g, or t
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaagacacaagaaaaaaaaaaaagaaaaataaaaccgcggggagttgtatgttgtgcgtgcgggcaggggcaaagaagaaaagnggtagcatatgacatacggcggcgcacatctgggtgcaataactgtggtgtcccgcggggaccgcaacttgttcttgtgtggcactaaagcggaggatcaatcgaggcggggggttcgccgcatacataggaggaggcgggacatgtataatgttcagaagataaaccgggtggtattaacgctggccttgatgggatggctggggggaaaagcttgggtttcaattccgaattcttaaaaagaaacgggattgttgaaaacactctgtaagcaggatactactgg

SEQ ID NO: 301356 - DNA, 763 bp, Homo sapiens
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaagccggggggacgctcgcgatctaaaactagggggggctctgacgctgctcggggaggtcccccgccgcccggcctcccggggtgtcccgggctcgcgcaggacgcagaagggcagtggacccaggtgggagagggagaagcacgaagacggggtgaagtggagacagctggagcacaggggcccgtatttcgacccccatagagccccttcccgaggagtgcgtttcttctatgaaggaaggcctgtgagattgagcgtgcagcggagaggtcgcacttattatgggaggatgttaccatctgata

SEQ ID NO: 301357 - DNA, 688 bp, Homo sapiens
  misc_feature (441)..(441): n is a, c, g, or t
  misc_feature (467)..(467): n is a, c, g, or t
  misc_feature (469)..(469): n is a, c, g, or t
  misc_feature (475)..(475): n is a, c, g, or t
  misc_feature (479)..(479): n is a, c, g, or t
  misc_feature (487)..(487): n is a, c, g, or t
  misc_feature (528)..(528): n is a, c, g, or t
  misc_feature (554)..(554): n is a, c, g, or t
  misc_feature (562)..(562): n is a, c, g, or t
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaacccnggaaggcaaaaagggaaaaacaacantnaaaacngggngctccagngctgaacaattgggcagatgaacccatttgacagaggatcnggctttggcaatggggtcagagggcnttgggggncaaagcagagaagtaaagggaatgggcatggggtcgtagagctactaacgggattactcgacaggggaaaccctactatgaaagtatccttgtccatgaccaagggttatgcagggacggggtggc

SEQ ID NO: 301358 - DNA, 1144 bp, Homo sapiens
  misc_feature (1144)..(1144): n is a, c, g, or t
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaagccgggggggggggccaataaaacccccggggggggccccctcgccccccctttttttgcaaacagggtggcccctaatagggtagggctattaaatagacgcgagggacgggggaggcatttaaaaaccaatggtgaggacaggtgaaaaaacgatgatagatgtcggagcatctggagggaaggcacagccaattagtggtgttgcgggtccactatacgggggcaccaccatgtccgaagaagatttatagagcgccgataggacaaatcaaaaagtaagcgtgtatattggtgataaccaagatcgtatatgctgtggttagaagacctgtgggcaccgcgggttagtgctttagaacacatctaacgggctcggacgtagacaccgagcggcagagtcactaagacaaacagcaagcaaagagcacggcacggagcacgcgagtctcagcgacaaacacggagacgaaccacacaacaagccatcagacacggaagcgctaaccacaagaacgcagcagaaccagacaacatgactagcaggagagcagaggatcaacgacgtacgaaccagcaagctagacacatggcaaggacatagatcgatgccgccgccacn

SEQ ID NO: 301359 - DNA, 1769 bp, Homo sapiens
gtttgagggcagcgatggctgtggagaaagctgccagcgctagcagagtcctcagcagggcctggggagggaggaggcagagagaaatctttgtgtttcaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaattgccttggcttgttaactttattagacattctgatgtttgcattgtgtaaatactgttgtattggaaaagcatgccaagatggattattgtaattcagtgtcttttttagtagtcaaatggtaaaatgcagcataagaatataagtcttccaagttagatatgagtgttagctttttataagtctgctcctgccagtttgactttgagatacattggagccaactgtaaactttagtttttaaattacagttagtttttttgtttgtttttgaggcggagtctctgttacccaggctggagtgcagtataccagtcttggcccacttcaacctccacttcttaggttcaagcgattctcctgcctcagcctcctgagtagctgggattgcaggcacgcaccaccatacctggctaatttttgtattttgagtagagatggagttttcaccacattggccaggctgttcttgaactgacctcaagcgatccacctgccttggccttccagagtgctgggattgcaggtgtgggccaccacgcccagccttgcatttaatatttttataatgtgtctaggctgggtgcggtgactcacgcctgaaatcccagcactttgggtggctgaggcaggtggattacttgaggccaggagattgagaccagtgtggccaacatagcaaaaacccgtctcgacgaaaaatacagaaaatagcttggtatggtggcacgtgcctgtagtcccagctactttggaggctcaggcacaagaatcacttgaacctacgaggcggaggttgcagtgagccaggatcgtgccactgcactttatttagccaggacaacactctgtctccaaaaaaaagtttctgaaggtaaaagatatactaaaggatatacatatactgcctcttctatgatgtttcatttgacctacaccatcagcatcttcaggaaacagtatgaaactaatttcacattaaatgttgcaaacgtctgcaattctccagtttttagtttgcacgtaaggattcgtaggattgatttcagattgacagatggttgtagtaacaaaaaaatgaattgccttggagaattcgagttattttaggcctgcctttgacacttttatgcacttaattcactgccaatttagtctaactcctcaaccatctgtggtatggacttctcagtcctcctaattggtatgtcttttatctatcccagagtcagtagtcctttaaggatgcaaatttaattcgataagaatgtggatttacttcatctttaggacagagtaaaaacctttatttca

SEQ ID NO: 301360 - DNA, 480 bp, Homo sapiens
  misc_feature (71)..(71): n is a, c, g, or t
  misc_feature (459)..(459): n is a, c, g, or t
gcggccgcctactactactaaattcgcggccgcgtcgacacgagaagacgacagaaggggctttctgggcncggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaagtcgacgcggccgcgaatttagtagtagtagnctagtagtagtaggcggccgc

SEQ ID NO: 301361 - DNA, 1075 bp, Homo sapiens
  misc_feature (1075)..(1075): n is a, c, g, or t
gaaaaaaactaggctagtacgggctggtgttaaatcaggccgaggcatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaaaaaaaaaaaaaaaaaaaaaaaaaaaaaaaagccgggggggggggccaataaaacccccggggggggccccctcgccccccctttttttgcaaacagggtggcccctaatagggtagggctattaaatagacgcgagggacgggggaggcatttaaaaaccaatggtgaggacaggtgaaaaaacgatgatagatgtcggagcatctggagggaaggcacagccaattagtggtgttgcgggtccactatacgggggcaccaccatgtccgaagaagatttatagagcgccgataggacaaatcaaaaagtaagcgtgtatattggtgataaccaagatcgtatatgctgtggttagaagacctgtgggcaccgcgggttagtgctttagaacacatctaacgggctcggacgtagacaccgagcggcagagtcactaagacaaacagcaagcaaagagcacggcacggagcacgcgagtctcagcgacaaacacggagacgaaccacacaacaagccatcagacacggaagcgctaaccacaagaacgcagcagaaccagacaacatgactagcaggagagcagaggatcaacgacgtacgaaccagcaagctagacacatggcaaggacatagatcgatgccgccgccacn

SEQ ID NO: 301362 - DNA, 613 bp, Homo sapiens
  misc_feature (438)..(439): n is a, c, g, or t
  misc_feature (441)..(441): n is a, c, g, or t
  misc_feature (448)..(449): n is a, c, g, or t
gagagagagagagagagagagagagagagagagagagagagagagagtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaccccggggccnntnttttgcnngggggcgggaacacagggggtatgtgaaggggcccgttggctcattagcgtgttccctgtgccccagtttccttggttccaagggggtaaactcggcgggtcccccttatagggagccgattaaattccgataagcccggggtaccggctatggtccgcgcaat

SEQ ID NO: 301363 - DNA, 1033 bp, Homo sapiens
gcggccgcctactactactactactactactaaattcgcggccgctcgaggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaactcggaattatttcctcctctttttcttccctggggccgaatttcggcacgagggaattttcttctcaggatttaaaaaaaaaatcggggggtggctaggatcccactcttcagatacgggagacactacaagggcagtatccccatcattcttctggtacgggatgcaggtttctccagcgggatttctggagctgatgggacataactaagcttaacgggggaatttggctgacccatttaaacttggcagagtgcaacttggcaatattcatggggccggtatatcagaccctatatgggtggcaaacccttggcgcaagatactcttgcagaaacgaattgcttcgacgctgtgcgttggagctcctcggataaaagggtgccctaggctcaagatgtcctcctgggcaattttggtggacaccacgcttctcctttagattatgggcaggtttcaacagcggttcgccttgacggaggtgggtcgaaatacgaccgaggaatgggcctctaacacaaaattgaccgggcaaccggcctttgaaaagggaaccggcttggactcttgaatgtgccccgatgggggaactcgggggggaggcacatgcgcaacggttatagaagtgc

SEQ ID NO: 301364 - DNA, 1737 bp, Homo sapiens
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaaagtgagtctagttccttgtggtatttggaagtgtgtggaccacataggcccaaattccaggttgctgctggatgggctagttttaacactttctcaggactgagagaataaggatgcctttgtattttcaggattcttccgtggtggtttattttcagttattgaaagagtaaacacaaaactaccaaaatagaagtcggaaatctaattcacagactactttagaatttgatggtcactgggcacattgttgtgaacattgtcatgatactgtgcaggtccattagtggggctgaatctactgaacgttgatttgcactgcaagttttgataaaaataggtgaaggggtcagttagttcaaaactgtatttggaacttgaggccatcaggaccaccacagtttcgtctttctgaacagtattagactgctgcaggtttgtgaatctgcaactcagtatcacctgacagggcgatactacaaacactatactacaaactagcatctagacctgtgttgtccaatacactaagcacatatatggctagtgtaattaaagaattggattttaaagtttcagtcaatttaaacttaaaccgaagcagtggaaaatgttgaaatatatatatattccttgtgggggtttttattagggcagaatggaaaatgggaactagagtgctttcttggttctgataggaaagtgaattatttatatacttacaatacaggatggtgattttcaggtatagttcctgaattttatggtaaaacttttgtagtcatttcaatagctgtctttcccaaaggcactttagtgtccgctcttatttccttaatcattgttctcactgtatcatcttgtaatttattcatttcttgtaatctgtccattcccttttaataagtttaggtcagcctcttagaaccatttctttttcatgggatggggtagggggagttaaagcttgcttgtccacaactgagttacttataaaaaaaaaagcaactctggttgagaaatcagatgcatgagattgtatgtctaattctgcaagatcctgaaggcatggctcttaaaggatgccatcatgtagtttagaagccactaatttccgaggagtaatctaatgttggttagatctttggattgactgcagcaaagtattggtagagcagtctatctcagtataattctttctaggaaaatttgggaagcgactttaacacaaaaacgaggcagatttacttatttgccattttctatgttaacatgcttaattatgttggaaactgaatctttctttccagtaccacttccgctgtcacggtaaagtccgccatcagaagactgaaggagttgaaagaccagtagacgctcctctactctttgagacatcactggcctataataaatgggttaatttatgtaacaaaa

SEQ ID NO: 301365 - DNA, 1709 bp, Homo sapiens
gagagagagagagagagagagagagagagagagagagagagagagagtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaaagtgagtctagttccttgtggtatttggaagtgtgtggaccacataggcccaaattccaggttgctgctggatgggctagttttaacactttctcaggactgagagaataaggatgcctttgtattttcaggattcttccgtggtggtttattttcagttattgaaagagtaaacacaaaactaccaaaatagaagtcggaaatctaattcacagactactttagaatttgatggtcactgggcacattgttgtgaacattgtcatgatactgtgcaggtccattagtggggctgaatctactgaacgttgatttgcactgcaagttttgataaaaataggtgaaggggtcagttagttcaaaactgtatttggaacttgaggccatcaggaccaccacagtttcgtctttctgaacagtattagactgctgcaggtttgtgaatctgcaactcagtatcacctgacagggcgatactacaaacactatactacaaactagcatctagacctgtgttgtccaatacactaagcacatatatggctagtgtaattaaagaattggattttaaagtttcagtcaatttaaacttaaaccgaagcagtggaaaatgttgaaatatatatatattccttgtgggggtttttattagggcagaatggaaaatgggaactagagtgctttcttggttctgataggaaagtgaattatttatatacttacaatacaggatggtgattttcaggtatagttcctgaattttatggtaaaacttttgtagtcatttcaatagctgtctttcccaaaggcactttagtgtccgctcttatttccttaatcattgttctcactgtatcatcttgtaatttattcatttcttgtaatctgtccattcccttttaataagtttaggtcagcctcttagaaccatttctttttcatgggatggggtagggggagttaaagcttgcttgtccacaactgagttacttataaaaaaaaaagcaactctggttgagaaatcagatgcatgagattgtatgtctaattctgcaagatcctgaaggcatggctcttaaaggatgccatcatgtagtttagaagccactaatttccgaggagtaatctaatgttggttagatctttggattgactgcagcaaagtattggtagagcagtctatctcagtataattctttctaggaaaatttgggaagcgactttaacacaaaaacgaggcagatttacttatttgccattttctatgttaacatgcttaattatgttggaaactgaatctttctttccagtaccacttccgctgtcacggtaaagtccgccatcagaagactgaaggagttgaaagaccagtagacgctcctctactctttgagacatcactggcctataataaatgggttaatttatgtaacaaaa

SEQ ID NO: 301366 - DNA, 2289 bp, Homo sapiens
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaagtaagtaaggcaaagtctctggtgagaggagagggagggcaggtttcttacccaagtgaggcctgacttcaaggtattttataagccgtgtgctggtgggcagttggaattactcataccgttgattatgagttttaagataaaagtgttgatggtaacttcagattttgtgagacgtttttcatttaaagaaaaccgcttaaacgttaatgggtaaaataatcatttgacagagtgcccccagcctaagccaaacctgctttgtgggaaatgattccatcagttttgtctactgatgtttctgcaccaactcccaaaatgtctgtgcatctaataccattctacttgttctgcgagggatttttgtttgataaaggtttgaacgtttatgtgcaaaatactgcattacagcaatccttgttttgtttttgagggagaaagggaggctttcacatccctgacaataaggtgaatccaaatttagacttctggatgcttgtaagagaaaatacttacttggttcatagtgaaaattggttctcttttatagaccaagatgaagagacgagctgtggggatctggcactgtggttcctgcatgaagacagtggctggcggtgcctggacgtacaaagtgagtctagttccttgtggtatttggaagtgtgtggaccacataggcccaaattccaggttgctgctggatgggctagttttaacactttctcaggactgagagaataaggatgcctttgtattttcaggattcttccgtggtggtttattttcagttattgaaagagtaaacacaaaactaccaaaatagaagtcggaaatctaattcacagactactttagaatttgatggtcactgggcacattgttgtgaacattgtcatgatactgtgcaggtccattagtggggctgaatctactgaacgttgatttgcactgcaagttttgataaaaataggtgaaggggtcagttagttcaaaactgtatttggaacttgaggccatcaggaccaccacagtttcgtctttctgaacagtattagactgctgcaggtttgtgaatctgcaactcagtatcacctgacagggcgatactacaaacactatactacaaactagcatctagacctgtgttgtccaatacactaagcacatatatggctagtgtaattaaagaattggattttaaagtttcagtcaatttaaacttaaaccgaagcagtggaaaatgttgaaatatatatatattccttgtgggggtttttattagggcagaatggaaaatgggaactagagtgctttcttggttctgataggaaagtgaattatttatatacttacaatacaggatggtgattttcaggtatagttcctgaattttatggtaaaacttttgtagtcatttcaatagctgtctttcccaaaggcactttagtgtccgctcttatttccttaatcattgttctcactgtatcatcttgtaatttattcatttcttgtaatctgtccattcccttttaataagtttaggtcagcctcttagaaccatttctttttcatgggatggggtagggggagttaaagcttgcttgtccacaactgagttacttataaaaaaaaaagcaactctggttgagaaatcagatgcatgagattgtatgtctaattctgcaagatcctgaaggcatggctcttaaaggatgccatcatgtagtttagaagccactaatttccgaggagtaatctaatgttggttagatctttggattgactgcagcaaagtattggtagagcagtctatctcagtataattctttctaggaaaatttgggaagcgactttaacacaaaaacgaggcagatttacttatttgccattttctatgttaacatgcttaattatgttggaaactgaatctttctttccagtaccacttccgctgtcacggtaaagtccgccatcagaagactgaaggagttgaaagaccagtagacgctcctctactctttgagacatcactggcctataataaatgggttaatttatgtaacaaaa

SEQ ID NO: 301367 - DNA, 2522 bp, Homo sapiens
  misc_feature (2522)..(2522): n is a, c, g, or t
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaaagtgagtctagttccttgtggtatttggaagtgtgtggaccacataggcccaaattccaggttgctgctggatgggctagttttaacactttctcaggactgagagaataaggatgcctttgtattttcaggattcttccgtggtggtttattttcagttattgaaagagtaaacacaaaactaccaaaatagaagtcggaaatctaattcacagactactttagaatttgatggtcactgggcacattgttgtgaacattgtcatgatactgtgcaggtccattagtggggctgaatctactgaacgttgatttgcactgcaagttttgataaaaataggtgaaggggtcagttagttcaaaactgtatttggaacttgaggccatcaggaccaccacagtttcgtctttctgaacagtattagactgctgcaggtttgtgaatctgcaactcagtatcacctgacagggcgatactacaaacactatactacaaactagcatctagacctgtgttgtccaatacactaagcacatatatggctagtgtaattaaagaattggattttaaagtttcagtcaatttaaacttaaaccgaagcagtggaaaatgttgaaatatatatatattccttgtgggggtttttattagggcagaatggaaaatgggaactagagtgctttcttggttctgataggaaagtgaattatttatatacttacaatacaggatggtgattttcaggtatagttcctgaattttatggtaaaacttttgtagtcatttcaatagctgtctttcccaaaggcactttagtgtccgctcttatttccttaatcattgttctcactgtatcatcttgtaatttattcatttcttgtaatctgtccattcccttttaataagtttaggtcagcctcttagaaccatttctttttcatgggatggggtagggggagttaaagcttgcttgtccacaactgagttacttataaaaaaaaaagcaactctggttgagaaatcagatgcatgagattgtatgtctaattctgcaagatcctgaaggcatggctcttaaaggatgccatcatgtagtttagaagccactaatttccgaggagtaatctaatgttggttagatctttggattgactgcagcaaagtattggtagagcagtctatctcagtataattctttctaggaaaatttgggaagcgactttaacacaaaaacgaggcagatttacttatttgccattttctatgttaacatgcttaattatgttggaaactgaatctttctttccagtaccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaagccgggggggggggccaataaaacccccggggggggccccctcgccccccctttttttgcaaacagggtggcccctaatagggtagggctattaaatagacgcgagggacgggggaggcatttaaaaaccaatggtgaggacaggtgaaaaaacgatgatagatgtcggagcatctggagggaaggcacagccaattagtggtgttgcgggtccactatacgggggcaccaccatgtccgaagaagatttatagagcgccgataggacaaatcaaaaagtaagcgtgtatattggtgataaccaagatcgtatatgctgtggttagaagacctgtgggcaccgcgggttagtgctttagaacacatctaacgggctcggacgtagacaccgagcggcagagtcactaagacaaacagcaagcaaagagcacggcacggagcacgcgagtctcagcgacaaacacggagacgaaccacacaacaagccatcagacacggaagcgctaaccacaagaacgcagcagaaccagacaacatgactagcaggagagcagaggatcaacgacgtacgaaccagcaagctagacacatggcaaggacatagatcgatgccgccgccacn

SEQ ID NO: 301368 - DNA, 679 bp, Homo sapiens
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaaagatgccaaaatggaaccaaatctccatgaactctgctaatggaagacgaggaaaaggcaggtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattgcaagatccaagatcatgcctcattaccttctgcctgtaaaacctgccccagcccccagctccaggagacagatttgagccaggctcctgtctttctctgcagccttgcaataaacttttctttctacaaaaaccca

SEQ ID NO: 301369 - DNA, 618 bp, Homo sapiens
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaagtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattgcaagatccaagatcatgcctcattaccttctgcctgtaaaacctgccccagcccccagctccaggagacagatttgagccaggctcctgtctttctctgcagccttgcaataaacttttctttctacaaaaaccca

SEQ ID NO: 301370 - DNA, 715 bp, Homo sapiens
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaaagtgagtctagttccttgtggtatttggaagtgtgtggaccacataggcccaaattccaggttgctgctggatgggctagttttaacactttctcaggactgagagaataaggatgcctttgtattttcaggattcttccgtggtggtttattttcagttattgaaagagtaaacacaaaactaccaaaatagaagtcggaaatctaattcacagactactttagaatttgatggtcactgggcacattgttgtgaacattgtcatgatactgtgcaggtccattagtggggctgaatctactgaacgttgatttgcactgcaagttttgataaaaataggtgaaggggtcagttagttcagattagaatggtgtcaggttgggaaatttgcacttaatttcacctggcaaggcg

SEQ ID NO: 301371 - DNA, 1064 bp, Homo sapiens
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaagtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattgcaagatccaagatcatgcctcattaccttctgcctgtaaaacctgccccagcccccagctccaggagacagatttgagccaggctcctgtctttctctgcagctgtggggatctggcactgtggttcctgcatgaaagacagtggctggcggggctggacgtacaagtaacctaagcaaacccaaatggaccaaatgcaacgctgatggaatctaagtgctcagacccaaggaacggggactgacactacagtggacaccacatggttgatcccaatccagattggagccctgggaaggatcatcccatgcgcagatccagttaagattacaacttcctgggcatacaccttcttgcagatccaagatcatgcctcattaccttttgcctgtaaaactggcccaccccagtccaggagacaattggagcaggccggttcccggcgccggagaaactttttctcagaaaacaaaacaaatcgcggacaacatgcacaaacaaaactcaaacacaaaaacagggggttcgcgagaacactaaccgagtaacaggcaacagcagtgaacgacacacgattgtggg

SEQ ID NO: 301372 - DNA, 353 bp, Homo sapiens
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccatttcccttttaacgttaagtgccccaataagagagcttaaggagttta

SEQ ID NO: 301373 - DNA, 221 bp, Homo sapiens
gcggccgcctactactactactactgctcgaattcaagcttctaacgatgtacggggacatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaa

SEQ ID NO: 301374 - DNA, 1301 bp, Homo sapiens
gcggccgcctactactactactactgctcgaattcaagcttctaacgatgtacggggacatgccaagatggattattgtaattcagtgtcttttttagtagtcaaatggtaaaatgcagcataagaatataagtcttccaagttagatatgagtgttagctttttataagtctgctcctgccagtttgactttgagatacattggagccaactgtaaactttagtttttaaattacagttagtttttttgtttgtttttgaggcggagtctctgttacccaggctggagtgcagtataccagtcttggcccacttcaacctccacttcttaggttcaagcgattctcctgcctcagcctcctgagtagctgggattgcaggcacgcaccaccatacctggctaatttttgtattttgagtagagatggagttttcaccacattggccaggctgttcttgaactgacctcaagcgatccacctgccttggccttccagagtgctgggattgcaggtgtgggccaccacgcccagccttgcatttaatatttttataatgtgtctaggctgggtgcggtgactcacgcctgaaatcccagcactttgggtggctgaggcaggtggattacttgaggccaggagattgagaccagtgtggccaacatagcaaaaacccgtctcgacgaaaaatacagaaaatagcttggtatggtggcacgtgcctgtagtcccagctactttggaggctcaggcacaagaatcacttgaacctacgaggcggaggttgcagtgagccaggatcgtgccactgcactttatttagccaggacaacactctgtctccaaaaaaaagtttctgaaggtaaaagatatactaaaggatatacatatactgcctcttctatgatgtttcatttgacctacaccatcagcatcttcaggaaacagtatgaaactaatttcacattaaatgttgcaaacgtctgcaattctccagtttttagtttgcacgtaaggattcgtaggattgatttcagattgacagatggttgtagtaacaaaaaaatgaattgccttggagaattcgagttattttaggcctgcctttgacacttttatgcacttaattcactgccaatttagtctaactcctcaaccatctgtggtatggacttctcagtcctcctaattggtatgtcttttatctatcccagagtcagtagtcctttaaggatgcaaatttaattcgataagaatgtggatttacttcatctttaggacagagtaaaaacctttatttca

SEQ ID NO: 301375 - DNA, 910 bp, Homo sapiens
ccccttcgagttcccgtccgaaattcgcggccgactactactactaaattcgcggccgcgtcgaccggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaggctgaggcaggtggattacttgaggccaggagattgagaccagtgtggccaacatagcaaaaacccgtctcgacgaaaaatacagaaaatagcttggtatggtggcacgtgcctgtagtcccagctactttggaggctcaggcacaagaatcacttgaacctacgaggcggaggttgcagtgagccaggatcgtgccactgcactttatttagccaggacaacactctgtctccaaaaaaaagtttctgaaggtaaaagatatactaaaggatatacatatactgcctcttctatgatgtttcatttgacctacaccatcagcatcttcaggaaacagtatgaaactaatttcacattaaatgttgcaaacgtctgcaattctccagtttttagtttgcacgtaaggattcgtaggattgatttcagattgacagatggttgtagtaacaaaaaaatgaattgccttggagaattcgagttattttaggcctgcctttgacacttttatgcacttaattcactgccaatttagtctaactcctcaaccatctgtggtatggacttctcagtcctcctaattggtatgtcttttatctatcccagagtcagtagtcctttaaggatgcaaatttaattcgataagaatgtggatttacttcatctttaggacagagtaaaaacctttatttca

SEQ ID NO: 301376 - DNA, 1006 bp, Homo sapiens
  misc_feature (1006)..(1006): n is a, c, g, or t
gcggccgcctactactactactactgctcgaattcaagcttctaacgatgtacggggacatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaagccgggggggggggccaataaaacccccggggggggccccctcgccccccctttttttgcaaacagggtggcccctaatagggtagggctattaaatagacgcgagggacgggggaggcatttaaaaaccaatggtgaggacaggtgaaaaaacgatgatagatgtcggagcatctggagggaaggcacagccaattagtggtgttgcgggtccactatacgggggcaccaccatgtccgaagaagatttatagagcgccgataggacaaatcaaaaagtaagcgtgtatattggtgataaccaagatcgtatatgctgtggttagaagacctgtgggcaccgcgggttagtgctttagaacacatctaacgggctcggacgtagacaccgagcggcagagtcactaagacaaacagcaagcaaagagcacggcacggagcacgcgagtctcagcgacaaacacggagacgaaccacacaacaagccatcagacacggaagcgctaaccacaagaacgcagcagaaccagacaacatgactagcaggagagcagaggatcaacgacgtacgaaccagcaagctagacacatggcaaggacatagatcgatgccgccgccacn

SEQ ID NO: 301377 - DNA, 485 bp, Homo sapiens
aaaacaacccccagcttagaccaaaacaaccctaagacaattgttacgagcatcgagagaacagatgtgaagcagagggagcccttgatgagttttgaccatcaagagatgccaaaatggaaccaaatctccatgaactctgctaatggaagacgaggaaaaggcaggtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattgcaagatccaagatcatgcctcattaccttctgcctgtaaaacctgccccagcccccagctccaggagacagatttgagccaggctcctgtctttctctgcagccttgcaataaacttttctttctacaaaaaccca

SEQ ID NO: 301378 - DNA, 608 bp, Homo sapiens
atcaccctgcaggagctgacacatacagaggagaggtcaaaagaggtccctggagaacacagtgatgcttctgagccacagtaaggatctagtccagccctaaatgagtccttgactgtattcagagtctggtaatgggaataacaggagaggggggtgggtttctaactgcatgaattaatccacaaagcagttttcctttgggaaggagaagaggtcttgcataccagcacagtggatggggaatggtgtgacctctgtccctgctctcttctctgctggcttaagggtctattctccatgtgtctatttctttgatgactttatactttttatgaaaggagcatcttttcattaaaccttcaaaaataaaggaagatacaaaaactaaagtacaaattacctgaaactcagcacccttttgtaaccattgtcagccctttggtgaatgtccttccagatatctccctgtacctgtgtacccagatagatatatgtatagataagagtgaccaaatataagtgctgttctatactgtgtatttttcaccaaataatgtatctcgtggacttctatgtcgatgaatatatataaatatctaacttca

SEQ ID NO: 301379 - DNA, 3508 bp, Homo sapiens
ggccctgacgtcaggggcaggggagggacggcgcaggcgcagaaaagggggcggcggactcggcttgttgtgttgctgcctgagtgccggagacggtcctgctgctgccgcagtcctgccagctgtccgacgatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcatcaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaacttt

SEQ ID NO: 301380 - DNA, 346 bp, Homo sapiens
ccctagttttagaagtttcaaagtttcaatagcagtttaaatgtttttcctagttttagaagtttcaatagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggccggtaaagttaagctacttctccatgtttacatcctactgatcttcaaaaagttgcagaaatgatt

SEQ ID NO: 301381 - DNA, 3590 bp, Homo sapiens
ggccctgacgtcaggggcaggggagggacggcgcaggcgcagaaaagggggcggcggactcggcttgttgtgttgctgcctgagtgccggagacggtcctgctgctgccgcagtcctgccagctgtccgacgatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcatcaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaactttaaaaaaaaaaaaaaaaaaaaaaaaaaaaaaaaaaaaaaaaaaaaaaaaaaaaaaaaaaaaaaaagggggggggcacaaaaaa

SEQ ID NO: 301382 - DNA, 3566 bp, Homo sapiens
ggccctgacgtcaggggcaggggagggacggcgcaggcgcagaaaagggggcggcggactcggcttgttgtgttgctgcctgagtgccggagacggtcctgctgctgccgcagtcctgccagctgtccgacgatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcatcaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaactttaaaaaaaaaaaaaaaaaaaaaaaaaaaaaaaaaaaaaaaagggggggggcacaaaaaa

SEQ ID NO: 301383 - DNA, 1380 bp, Homo sapiens
  misc_feature (1380)..(1380): n is a, c, g, or t
ggccctgacgtcaggggcaggggagggacggcgcaggcgcagaaaagggggcggcggactcggcttgttgtgttgctgcctgagtgccggagacggtcctgctgctgccgcagtcctgccagctgtccgacgatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaggtgatccccggtcggcaaaagcan

SEQ ID NO: 301384 - DNA, 3454 bp, Homo sapiens
ggccctgacgtcaggggcaggggagggacggcgcaggcgcagaaaagggggcggcggactcggcttgttgtgttgctgcctgagtgccggagacggtcctgctgctgccgcagtcctgccagctgtccgacgatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggtatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcatcaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaacttt

SEQ ID NO: 301385 - DNA, 3455 bp, Homo sapiens
ggccctgacgtcaggggcaggggagggacggcgcaggcgcagaaaagggggcggcggactcggcttgttgtgttgctgcctgagtgccggagacggtcctgctgctgccgcagtcctgccagctgtccgacgatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgagtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcatcaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaacttt

SEQ ID NO: 301386 - DNA, 3345 bp, Homo sapiens
tggggtcttgggcccggggccgtttgggctcgcggtccgggagcggcgcgggtagcgcggatccccctggttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcatcaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaacttt

SEQ ID NO: 301387 - DNA, 3097 bp, Homo sapiens
tgaataggaacagctccggtctacagctcccagcatgagcgacgcagaagacgggtgatttctgcatttccatctgagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcatcaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaacttt

SEQ ID NO: 301388 - DNA, 3482 bp, Homo sapiens
ccttaagcgattggtgtctataccttgccgtctctctttcagtcatcttcagattgtttgtcttggctgtaagtataactattgctatagatgaatgtaaaaagagtgtttaaaaagttcgttgctttaattgcactggaggtgaagctagttacatactttccttaacttcccttctgcttttgctgttgaagaggccaaatactttcttggcatgaaaaagtattataaggcccctaatccttaggagttattagtaagagctgtctttaaagcactggcagcttttaaggttttttttttcttttgtcctacatagagcaccagaataatttcacatattactatatttttgtgtctgaaatgtcagtagaaccttctgtccaccaaagaggaacatcttgaaggagttgggctgctttatttactctgtggagggatctgttctctctggctttactttgtctaatcactacccctttgctgtcgagccccgatatttaatgagtaaacaaactcatataaaaccagtttggccgggctggtgactggttttaagaaagtcagtgatgatttcacggtgtttggggagcggtacccacaaacctttagagccttttacaaagactgaagagttttaagtagagttcaacctgtggacaagctggtatagaactgttgaaacaggtgaaacatgatgcttctgcttcctttcagcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcatcaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaacttt

SEQ ID NO: 301389 - DNA, 1343 bp, Homo sapiens
ggccctgacgtcaggggcaggggagggacggcgcaggcgcagaaaagggggcggcggactcggcttgttgtgttgctgcctgagtgccggagacggtcctgctgctgccgcagtcctgccagctgtccgacgatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagctagttgttttttttcccccaagacaaaggcaagtttccctaagtttgagttgatagttatt

SEQ ID NO: 301390 - DNA, 2415 bp, Homo sapiens
gcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcatcaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaacttt

SEQ ID NO: 301391 - DNA, 3453 bp, Homo sapiens
ggccctgacgtcaggggcaggggagggacggcgcaggcgcagaaaagggggcggcggactcggcttgttgtgttgctgcctgagtgccggagacggtcctgctgctgccgcagtcctgccagctgtccgacgatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaagtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcatcaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaacttt

SEQ ID NO: 301392 - DNA, 3454 bp, Homo sapiens
ggccctgacgtcaggggcaggggagggacggcgcaggcgcagaaaagggggcggcggactcggcttgttgtgttgctgcctgagtgccggagacggtcctgctgctgccgcagtcctgccagctgtccgacgatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgatcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcatcaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaacttt

SEQ ID NO: 301393 - DNA, 3415 bp, Homo sapiens
actttttgtccaagaaaacttttcgtgtttgcctgtagctgatgtgcagttgtttctgctcccaaatcaacagggtttaatgaaaaccctagaaagtagaaacccgtgggagagaaaagaaaaaagacaagttcacaaggttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcatcaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaacttt

SEQ ID NO: 301394 - DNA, 3483 bp, Homo sapiens
ggccctgacgtcaggggcaggggagggacggcgcaggcgcagaaaagggggcggcggactcggcttgttgtgttgctgcctgagtgccggagacggtcctgctgctgccgcagtcctgccagctgtccgacgatgtcgtcccacctagtcgagccgccgccgcccctgcacaacaacaacaacaactgcgaggaaaatgagcagtctgttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcatcaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaacttt

SEQ ID NO: 301395 - DNA, 2635 bp, Homo sapiens
  misc_feature (17)..(17): n is a, c, g, or t
  misc_feature (104)..(104): n is a, c, g, or t
  misc_feature (122)..(122): n is a, c, g, or t
aaagtaggtgtgaaagnaagaggtcctaccagtcggcaagctcacacagacgtcagggaagaccacacagacacacagagagacagcaggagatggaaagagcntcaaagcgtttaaggganatttgcaaagcagatgctggacccagcaaactatggaactgggatggagaggtggccaagaacacctaaggaagaggcccaatcactagaagacctggccggcttcaaagagctcttccagacaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcatcaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaacttt

SEQ ID NO: 301396 - DNA, 886 bp, Homo sapiens
  misc_feature (421)..(421): n is a, c, g, or t
ggccctgacgtcaggggcaggggagggacggcgcaggcgcagaaaagggggcggcggactcggcttgttgtgttgctgcctgagtgccggagacggtcctgctgctgccgcagtcctgccagctgtccgacgatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaaaaataatgaaaaaggaaaagacttatataatgcacttacaaaggaactgggagcagaatataagccaaacaacattgcactgctgnagatttctccttgggccatctatgtatgagaggtcgtgaacaaataataaatggatatatagagcacggcaacgggaatccatgatctactcgagggggatagaattaataggaggatcatatcagaattatcaacgagggaaaggtatggagtacgtgatgtaattatcgggttataaaccgttaatgccgccgaaaacgtaacctgcccatagttaggggctactggcagaacactgcaagtatatagctaaaatacgaatgatcgggaacagagaagcgatgaagtagacccataaaatgataaggaggaaagaaaaggtactctcgagcgaacaggggatctaaattggaaaaaggctataacctatattacaactgtgtcgtgatgacgataatattttaactgaattttgacgaattaccatctaagagggatatgaacatagaaatggcagtgtattg

SEQ ID NO: 301397 - DNA, 1834 bp, Homo sapiens
  misc_feature (1834)..(1834): n is a, c, g, or t
ggcggagcggcgccccggccaatcagcggcagtccccgaacgttgggccggcccagccccgccccgcgctgttgtttgtggtgtcggccgggccgcgggagtcgaaccacaacattcgccgggcgggcggcggcggagcgggcggcggagcggcggcagcagcggtgagcgcgagccccggagccccgggcggccggcctcccgcgcccgcgcagccccgcgtctgcgtccggccggagacgccgggccccgcgccgcgccgcgccatgtcggtgaacatggacgagctgcggcaccaggtcatgatcaaccagttcgtgctggccgcgggctgcgcggccgaccaggcgaagcagctgctgcaggcggcccactggcagttcgagaccgcgctgagcacgttcttccaagaaaccaacattcccaacagccaccaccaccaccagatgatgtgcactcccagcaacacccctgccacgccgcccaacttccccgatgcgctggccatgttctccaagctccgcgcctccgagggcctgcagagcagcaacagccccatgacagccgcagcctgctccccacctgcaaacttcagccccttctgggcctcgtccccgcccagccaccaggcgccctggatcccgccctcctcccccaccaccttccaccacctccaccgcccacagcccacgtggcccccaggagcacagcaggggggcgcccagcagaaagccatggcggccatggacggccagagatgagactggacgccgccgggcgctgggctggagctgggggcagcccagggttgtggggacacaggagggccagggaggggggagccggggagggcagggggtttcccgaagatcgcactggaagattttataaaagaatttttgtgggtcggggggacagtaaacttcctgggccacgtgggtccttcaggagtttttcaggcaagtttttcctctgtttttaatatataactataatatatatgaatagataaatataactaatgtgcgtgagaatgggcctggcacacctggggtgctcgggggtagggctgccatgctgcagagctgatggagtgatgttgtgggcacaaggcatctgtcagctgcctcctttaacagccatgccttctggaatctggaagaggacaccactcctgcagtcactgggcagccacatagcagctgcaggtcccaggagggcctgaggtcaaagctgtggaaggccctcttggtatcagggctctctccccatggcctcttccccacctctgattgctggttgtggccccatagctcatcacccctgtctcctgctgaatgtgcagggctgatgtggcactgaggagctgactttggtcaaaggccaggctctgcccagcaggggacttgactgccctgggcgccctgcccctcccgctgcgtgtccaggtccaaagtggagagcctgcctttgggtttagttcccgaatcagaatcccatctcaccagggcgaaattttaatttaaaaacttaaaaagagacttttctaacttcaaaaaaaaaaggaaaataaaactatgtctaaaagtaaacaaaaaaaggggggggcgaataaatatatccttggggggccatgttggtgcacccgcggttttgtgtaaagggtggcccataagggggcagtataaagcaaggaagggcggggttaaaaacggtgagggaaaagcgatgggggtcttgtgaaagacacgatttgggtgagataatgggaccaccagaggtattagctggatataaattatgttggcacgcttggggatgtgttacaataagn

SEQ ID NO: 301398 - DNA, 1578 bp, Homo sapiens
ggcggagcggcgccccggccaatcagcggcagtccccgaacgttgggccggcccagccccgccccgcgctgttgtttgtggtgtcggccgggccgcgggagtcgaaccacaacattcgccgggcgggcggcggcggagcgggcggcggagcggcggcagcagcggtgagcgcgagccccggagccccgggcggccggcctcccgcgcccgcgcagccccgcgtctgcgtccggccggagacgccgggccccgcgccgcgccgcgccatgtcggtgaacatggacgagctgcggcaccaggtcatgatcaaccagttcgtgctggccgcgggctgcgcggccgaccaggcgaagcagctgctgcaggcggcccactggcagttcgagaccgcgctgagcacgttcttccaagaaaccaacattcccaacagccaccaccaccaccagatgatgtgcactcccagcaacacccctgccacgccgcccaacttccccgatgcgctggccatgttctccaagctccgcgcctccgagggcctgcagagcagcaacagccccatgacagccgcagcctgctccccacctgcaaacttcagccccttctgggcctcgtccccgcccagccaccaggcgccctggatcccgccctcctcccccaccaccttccaccacctccaccgcccacagcccacgtggcccccaggagcacagcaggggggcgcccagcagaaagccatggcggccatggacggccagagatgagactggacgccgccgggcgctgggctggagctgggggcagcccagggttgtggggacacaggagggccagggaggggggagccggggagggcagggggtttcccgaagatcgcactggaagattttataaaagaatttttgtgggtcggggggacagtaaacttcctgggccacgtgggtccttcaggagtttttcaggcaagtttttcctctgtttttaatatataactataatatatatgaatagataaatataactaatgtgcgtgagaatgggcctggcacacctggggtgctcgggggtagggctgccatgctgcagagctgatggagtgatgttgtgggcacaaggcatctgtcagctgcctcctttaacagccatgccttctggaatctggaagaggacaccactcctgcagtcactgggcagccacatagcagctgcaggtcccaggagggcctgaggtcaaagctgtggaaggccctcttggtatcagggctctctccccatggcctcttccccacctctgattgctggttgtggccccatagctcatcacccctgtctcctgctgaatgtgcagggctgatgtggcactgaggagctgactttggtcaaaggccaggctctgcccagcaggggacttgactgccctgggcgccctgcccctcccgctgcgtgtccaggtccaaagtggagagcctgcctttgggtttagttcccgaatcagaatcccatctcaccagggcgaaattttaatttaaaaacttaaaaagagacttttctaacttcaacaaacaacacacgcaagcaacc

SEQ ID NO: 301399 - DNA, 1612 bp, Homo sapiens
  misc_feature (1612)..(1612): n is a, c, g, or t
ggcggagcggcgccccggccaatcagcggcagtccccgaacgttgggccggcccagccccgccccgcgctgttgtttgtggtgtcggccgggccgcgggagtcgaaccacaacattcgccgggcgggcggcggcggagcgggcggcggagcggcggcagcagcgaccgcgctgagcacgttcttccaagaaaccaacattcccaacagccaccaccaccaccagatgatgtgcactcccagcaacacccctgccacgccgcccaacttccccgatgcgctggccatgttctccaagctccgcgcctccgagggcctgcagagcagcaacagccccatgacagccgcagcctgctccccacctgcaaacttcagccccttctgggcctcgtccccgcccagccaccaggcgccctggatcccgccctcctcccccaccaccttccaccacctccaccgcccacagcccacgtggcccccaggagcacagcaggggggcgcccagcagaaagccatggcggccatggacggccagagatgagactggacgccgccgggcgctgggctggagctgggggcagcccagggttgtggggacacaggagggccagggaggggggagccggggagggcagggggtttcccgaagatcgcactggaagattttataaaagaatttttgtgggtcggggggacagtaaacttcctgggccacgtgggtccttcaggagtttttcaggcaagtttttcctctgtttttaatatataactataatatatatgaatagataaatataactaatgtgcgtgagaatgggcctggcacacctggggtgctcgggggtagggctgccatgctgcagagctgatggagtgatgttgtgggcacaaggcatctgtcagctgcctcctttaacagccatgccttctggaatctggaagaggacaccactcctgcagtcactgggcagccacatagcagctgcaggtcccaggagggcctgaggtcaaagctgtggaaggccctcttggtatcagggctctctccccatggcctcttccccacctctgattgctggttgtggccccatagctcatcacccctgtctcctgctgaatgtgcagggctgatgtggcactgaggagctgactttggtcaaaggccaggctctgcccagcaggggacttgactgccctgggcgccctgcccctcccgctgcgtgtccaggtccaaagtggagagcctgcctttgggtttagttcccgaatcagaatcccatctcaccagggcgaaattttaatttaaaaacttaaaaagagacttttctaacttcaaaaaaaaaaggaaaataaaactatgtctaaaagtaaacaaaaaaaggggggggcgaataaatatatccttggggggccatgttggtgcacccgcggttttgtgtaaagggtggcccataagggggcagtataaagcaaggaagggcggggttaaaaacggtgagggaaaagcgatgggggtcttgtgaaagacacgatttgggtgagataatgggaccaccagaggtattagctggatataaattatgttggcacgcttggggatgtgttacaataagn

SEQ ID NO: 301400 - DNA, 1747 bp, Homo sapiens
  misc_feature (1747)..(1747): n is a, c, g, or t
ggcggagcggcgccccggccaatcagcggcagtccccgaacgttgggccggcccagccccgccccgcgctgttgtttgtggtgtcggccgggccgcgggagtcgaaccacaacattcgccgggcgggcggcggcggagcgggcggcggagcggcggcagcagcggtgagcgcgagccccggagccccgggcggccggcctcccgcgcccgcgcagccccgcgtctgcgtccggccggagacgccgggccccgcgccgcgccgcgccatgtcggtgaacatggacgagctgcggcaccaggtcatgatcaaccagttcgtgctggccgcgggctgcgcggccgaccaggcgaagcagctgctgcaggcggcccactggcagttcgagaccgcgctgagcacgttcttccaagaaaccaacattcccaacagccaccaccaccaccagatgatgtgcactcccagcaacacccctgccacgccgcccaacttccccgatgcgctggccatgttctccaagctccgcgcctccgagggcctgcagagcagcaacagccccatgacagccgcagcctgctccccacctgcaaacttcagccccttctgggcctcgtccccgcccagccaccaggcgccccagcagaaagccatggcggccatggacggccagagatgagactggacgccgccgggcgctgggctggagctgggggcagcccagggttgtggggacacaggagggccagggaggggggagccggggagggcagggggtttcccgaagatcgcactggaagattttataaaagaatttttgtgggtcggggggacagtaaacttcctgggccacgtgggtccttcaggagtttttcaggcaagtttttcctctgtttttaatatataactataatatatatgaatagataaatataactaatgtgcgtgagaatgggcctggcacacctggggtgctcgggggtagggctgccatgctgcagagctgatggagtgatgttgtgggcacaaggcatctgtcagctgcctcctttaacagccatgccttctggaatctggaagaggacaccactcctgcagtcactgggcagccacatagcagctgcaggtcccaggagggcctgaggtcaaagctgtggaaggccctcttggtatcagggctctctccccatggcctcttccccacctctgattgctggttgtggccccatagctcatcacccctgtctcctgctgaatgtgcagggctgatgtggcactgaggagctgactttggtcaaaggccaggctctgcccagcaggggacttgactgccctgggcgccctgcccctcccgctgcgtgtccaggtccaaagtggagagcctgcctttgggtttagttcccgaatcagaatcccatctcaccagggcgaaattttaatttaaaaacttaaaaagagacttttctaacttcaaaaaaaaaaggaaaataaaactatgtctaaaagtaaacaaaaaaaggggggggcgaataaatatatccttggggggccatgttggtgcacccgcggttttgtgtaaagggtggcccataagggggcagtataaagcaaggaagggcggggttaaaaacggtgagggaaaagcgatgggggtcttgtgaaagacacgatttgggtgagataatgggaccaccagaggtattagctggatataaattatgttggcacgcttggggatgtgttacaataagn

SEQ ID NO: 301401 - DNA, 1458 bp, Homo sapiens
  misc_feature (1458)..(1458): n is a, c, g, or t
ggcggagcggcgccccggccaatcagcggcagtccccgaacgttgggccggcccagccccgccccgcgctgttgtttgtggtgtcggccgggccgcgggagtcgaaccacaacattcgccgggcgggcggcggcggagcgggcggcggagcggcggcagcagcggtgagcgcgagccccggagccccgggcggccggcctcccgcgcccgcgcagccccgcgtctgcgtccggccggagacgccgggccccgcgccgcgccgcgccatgtcggtgaacatggacgagctgcggcaccaggtcatgatcaaccagttcgtgctggccgcgggctgcgcggccgaccaggcgaagcagctgctgcaggcggcccactggcagttcgagaccgcgctgagcacgttcttccaagaaaccaacattcccaacagccaccaccaccaccagatgatgtgcactcccagcaacacccctgccacgccgcccaacttccccgatgcgtggaagattttataaaagaatttttgtgggtcggggggacagtaaacttcctgggccacgtgggtccttcaggagtttttcaggcaagtttttcctctgtttttaatatataactataatatatatgaatagataaatataactaatgtgcgtgagaatgggcctggcacacctggggtgctcgggggtagggctgccatgctgcagagctgatggagtgatgttgtgggcacaaggcatctgtcagctgcctcctttaacagccatgccttctggaatctggaagaggacaccactcctgcagtcactgggcagccacatagcagctgcaggtcccaggagggcctgaggtcaaagctgtggaaggccctcttggtatcagggctctctccccatggcctcttccccacctctgattgctggttgtggccccatagctcatcacccctgtctcctgctgaatgtgcagggctgatgtggcactgaggagctgactttggtcaaaggccaggctctgcccagcaggggacttgactgccctgggcgccctgcccctcccgctgcgtgtccaggtccaaagtggagagcctgcctttgggtttagttcccgaatcagaatcccatctcaccagggcgaaattttaatttaaaaacttaaaaagagacttttctaacttcaaaaaaaaaaggaaaataaaactatgtctaaaagtaaacaaaaaaaggggggggcgaataaatatatccttggggggccatgttggtgcacccgcggttttgtgtaaagggtggcccataagggggcagtataaagcaaggaagggcggggttaaaaacggtgagggaaaagcgatgggggtcttgtgaaagacacgatttgggtgagataatgggaccaccagaggtattagctggatataaattatgttggcacgcttggggatgtgttacaataagn

SEQ ID NO: 301402 - DNA, 1737 bp, Homo sapiens
  misc_feature (1737)..(1737): n is a, c, g, or t
ggcggagcggcgccccggccaatcagcggcagtccccgaacgttgggccggcccagccccgccccgcgctgttgtttgtggtgtcggccgggccgcgggagtcgaaccacaacattcgccgggcgggcggcggcggagcgggcggcggagcggcggcagcagcggtgagcgcgagccccggagccccgggcggccggcctcccgcgcccgcgcagccccgcgtctgcgtccggccggagacgccgggccccgcgccgcgccgcgccatgtcggtgaacatggacgagctgcggcaccaggtcatgatcaaccagttcgtgctggccgcgggctgcgcggccgaccaggcgaagcagctgctgcaggcggcccactggcagttcgagaccgcgctgagcacgttcttccaagaaaccaacattcccaacagccaccaccaccaccagatgatgtgcactcccagcaacacccctgccacgccgcccaacttccccgatgcgctggccatgttctccaagctccgcgcctccgagggcctgcagagcagcaacagccccatgacagccgcagcctgctccccacctgcaaacttcagccccttctgggcctcgtccccgcccagccaccaggcgccctggatcccgccctcctcccccaccaccttccaccacctccaccgcccacagcccacgtggcccccaggagcacagcaggggggcgcccagcagaaagccatggcggccatggacggccagagatgagactggacgccgccgggcgctgggctggagctgggggcagcccagggttgtggggacacaggagggccagggaggggggagccggggagggcagggggtttcccgaagatcgcactggaagattttataaaagaatttttgtgggtcggggggacagtaaacttcctgggccacgtgggtccttcaggagtttttcaggcaagtttttcctctgtttttaatatataactataatatatatgaatagataaatataactaatgtgcgtgagaatgggcctggcacacctggggtgctcgggggtagggctgccatgctgcagtcactgggcagccacatagcagctgcaggtcccaggagggcctgaggtcaaagctgtggaaggccctcttggtatcagggctctctccccatggcctcttccccacctctgattgctggttgtggccccatagctcatcacccctgtctcctgctgaatgtgcagggctgatgtggcactgaggagctgactttggtcaaaggccaggctctgcccagcaggggacttgactgccctgggcgccctgcccctcccgctgcgtgtccaggtccaaagtggagagcctgcctttgggtttagttcccgaatcagaatcccatctcaccagggcgaaattttaatttaaaaacttaaaaagagacttttctaacttcaaaaaaaaaaggaaaataaaactatgtctaaaagtaaacaaaaaaaggggggggcgaataaatatatccttggggggccatgttggtgcacccgcggttttgtgtaaagggtggcccataagggggcagtataaagcaaggaagggcggggttaaaaacggtgagggaaaagcgatgggggtcttgtgaaagacacgatttgggtgagataatgggaccaccagaggtattagctggatataaattatgttggcacgcttggggatgtgttacaataagn

SEQ ID NO: 301403 - DNA, 1736 bp, Homo sapiens
  misc_feature (1736)..(1736): n is a, c, g, or t
ggcggagcggcgccccggccaatcagcggcagtccccgaacgttgggccggcccagccccgccccgcgctgttgtttgtggtgtcggccgggccgcgggagtcgaaccacaacattcgccgggcgggcggcggcggagcgggcggcggagcggcggcagcagcggtgagcgcgagccccggagccccgggcggccggcctcccgcgcccgcgcagccccgcgtctgcgtccggccggagacgccgggccccgcgccgcgccgcgccatgtcggtgaacatggacgagctgcggcaccaggtcatgatcaaccagttcgtgctggccgcgggctgcgcggccgaccaggcgaagcagctgctgcaggcggcccactggcagttcgagaccgcgctgagcacgttcttccaagaaaccaacattcccaacagccaccaccaccaccagatgatgtgcactcccagcaacacccctgccacgccgcccaacttccccgatgcgctggccatgttctccaagctccgcgcctccgagggcctgcagagcagcaacagccccatgacagccgcagcctgctccccacctgcaaacttcagccccttctgggcctcgtccccgcccagccaccaggcgccctggatcccgccctcctcccccaccaccttccaccacctccaccgcccacagcccacgtggcccccaggagcacagcaggggggcgcccagcagaaagccatggcggccatggacggccagagatgagactggacgccgccgggcgctgggctggagctgggggcagcccagggttgtggggacacaggagggccagggaggggggagccggggagggcagggggtttcccgaagatcgcactggaagattttataaaagaatttttgtgggtcggggggacagtaaacttcctgggccacgtgggtccttcaggagtttttcaggcaagtttttcctctgtttttaatatataactataatatatatgaatagataaatataactaatgtgcgtgagaatgggcctggcacacctggggtgctcgggggtagggctgccatgctgcagagctgatggagtgatgttgtgggcacaaggcatctgtcagctgcctcctttaacagccatgccttctggaatctggaagaggacaccactcctgcagtcactgggcagccacatagcagctgcaggtcccaggagggcctgaggtcaaagctgtggaaggccctcttggtatcagggctctctccccatggcctcttccccacctctgattgctggttgtggccccatagctcatcacccctgtctcctgctgaatgtgcagggctgatgtggcactgaggagctgcctttgggtttagttcccgaatcagaatcccatctcaccagggcgaaattttaatttaaaaacttaaaaagagacttttctaacttcaaaaaaaaaaggaaaataaaactatgtctaaaagtaaacaaaaaaaggggggggcgaataaatatatccttggggggccatgttggtgcacccgcggttttgtgtaaagggtggcccataagggggcagtataaagcaaggaagggcggggttaaaaacggtgagggaaaagcgatgggggtcttgtgaaagacacgatttgggtgagataatgggaccaccagaggtattagctggatataaattatgttggcacgcttggggatgtgttacaataagn

SEQ ID NO: 301404 - DNA, 1644 bp, Homo sapiens
  misc_feature (1644)..(1644): n is a, c, g, or t
ggcggagcggcgccccggccaatcagcggcagtccccgaacgttgggccggcccagccccgccccgcgctgttgtttgtggtgtcggccgggccgcgggagtcgaaccacaacattcgccgggcgggcggcggcggagcgggcggcggagcggcggcagcagcggtgagcgcgagccccggagccccgggcggccggcctcccgcgcccgcgcagccccgcgtctgcgtccggccggagacgccgggccccgcgccgcgccgcgccatgtcggtgaacatggacgagctgcggcaccaggtcatgatcaaccagttcgtgctggccgcgggctgcgcggccgaccaggcgaagcagctgctgcaggcggcccactggcagttcgagaccgcgctgagcacgttcttccaagaaaccaacattcccaacagccaccaccaccaccagatgatgtgcactcccagcaacacccctgccacgccgcccaacttccccgatgcgctggccatgttctccaagctccgcgcctccgagggcctgcagagcagcaacagccccatgacagccgcagcctgctccccacctgcaaacttcagccccttctgggcctcgtccccgcccagccaccaggcgccctggatcccgccctcctcccccaccaccttccaccacctccaccgcccacagcccacgtggcccccaggagcacagcaggggggcgcccagcagaaagccatggcggccatggacggccagagatgagactggacgccgccgggcgctgggctggagctgggggcagcccagggttgtggggacacaggagggccagggaggggggagccggggagggcagggggtttcccgaagatcgcactggaagattttataaaagaatttttgtgggtcggggggacagtaaacttcctgggccacgtgggtccttcaggagtttttcaggcaagtttttcctctgtttttaatatataactataatatatatgaatagataaatataactaatgtgcgtgagaatgggcctggcacacctggggtgctcgggggtagggctgccatgctgcagagctgatggagtgatgttgtgggcacaaggcatctgtcagctgcctcctttaacagccatgccttctggaagggctgatgtggcactgaggagctgactttggtcaaaggccaggctctgcccagcaggggacttgactgccctgggcgccctgcccctcccgctgcgtgtccaggtccaaagtggagagcctgcctttgggtttagttcccgaatcagaatcccatctcaccagggcgaaattttaatttaaaaacttaaaaagagacttttctaacttcaaaaaaaaaaggaaaataaaactatgtctaaaagtaaacaaaaaaaggggggggcgaataaatatatccttggggggccatgttggtgcacccgcggttttgtgtaaagggtggcccataagggggcagtataaagcaaggaagggcggggttaaaaacggtgagggaaaagcgatgggggtcttgtgaaagacacgatttgggtgagataatgggaccaccagaggtattagctggatataaattatgttggcacgcttggggatgtgttacaataagn

SEQ ID NO: 301405 - DNA, 1152 bp, Homo sapiens
  misc_feature (1141)..(1141): n is a, c, g, or t
  misc_feature (1146)..(1146): n is a, c, g, or t
ggcggagcggcgccccggccaatcagcggcagtccccgaacgttgggccggcccagccccgccccgcgctgttgtttgtggtgtcggccgggccgcgggagtcgaaccacaacattcgccgggcgggcggcggcggagcgggcggcggagcggcggcagcagcggtgagcgcgagccccggagccccgggcggccggcctcccgcgcccgcgcagccccgcgtctgcgtccggccggagacgccgggccccgcgccgcgccgcgccatgtcggtgaacatggacgagctgcggcaccaggtcatgatcaaccagttcgtgctggccgcgggctgcgcggccgaccaggcgaagcagctgctgcaggcggcccactggcagttcgagaccgcgctgagcacgttcttccaagaaaccaacattcccaacagccaccaccaccaccagatgatgtgcactcccagcaacacccctgccacgccgcccaacttccccgatgcgctggccatgttctccaagctccgcgcctccgagggcctgcagagcagcaacagccccatgacagccgcagcctgctccccacctgcaaacttcagccccttctgggcctcgtccccgcccagccaccaggcgccctggatcccgccctcctcccccaccaccttccaccacctccaccgcccacagcccacgtggcccccaggagcacagcaggggggcgcccagcagaaagccatggcggccatggacggccagagatgagactggacgccgccgggcgctgggctggagctgggggcagcccagggttgtggggacacaggagggccagggaggggggagccggggagggcagggggtttcccgaagatcgcactggaagattttataaaagaatttttgtgggtcggggggacagtaaacttcctgggccacgtgggtccttcaggagtttttcaggcaagtttttcctctgtttttaatatataactataatatatatgaatagataaatataactaatgtgcgtgagaatgggcctggcacacctggggtgctcgggggtagggctgccatgctgcagagctgatggagtgatgttgtgggcaggggggggggggggggggggggggctttaacanccatnccttct

SEQ ID NO: 301406 - DNA, 950 bp, Homo sapiens
ggcggagcggcgccccggccaatcagcggcagtccccgaacgttgggccggcccagccccgccccgcgctgttgtttgtggtgtcggccgggccgcgggagtcgaaccacaacattcgccgggcgggcggcggcggagcgggcggcggagcggcggcagcagcggtgagcgcgagccccggagccccgggcggccggcctcccgcgcccgcgcagccccgcgtctgcgtccggccggagacgccgggccccgcgccgcgccgcgccatgtcggtgaacatggacgagctgcggcaccaggtcatgatcaaccagttcgtgctggccgcgggctgcgcggccgaccaggcgaagcagctgctgcaggcggcccactggcagttcgagaccgcgctgagcacgttcttccaagaaaccaacattcccaacagccaccaccaccaccagatgatgtgcactcccagcaacacccctgccacgccgcccaacttccccgatgcgctggccatgttctccaagctccgcgcctccgagggcctgcagagcagcaacagccccatgacagccgcagcctgctccccacctgcaaacttcagccccttctgggcctcgtccccgcccagccaccaggcgccctggatcccgccctcctcccccaccaccttccaccacctccaccgcccacagcccacgtggcccccaggagcacagcaggggggcgcccagcagaaagccatggcggccatggacggccagagatgagactggacgccgccgggcgctgggctggagctgggggcagcccagggttgtggggacacaggagggccagggaggggggagccggggagggcagggggtttcccgaagatcgcactggaagattttataaaagaatttttgtgggtcggggggacagtaaacttcctgggccacgtgggtccttcagga

SEQ ID NO: 301407 - DNA, 751 bp, Homo sapiens
  misc_feature (5)..(5): n is a, c, g, or t
  misc_feature (8)..(8): n is a, c, g, or t
agcgngcntgcgtagccggcgggctggcagtgagactgactgcgtcggggttgagactgggtggatgaggctcaccccggcggggagaagggacgaggaggggcggacagcggaaggtccgggagtgtccgccataaagtcgtttgaggtgaccgttgcgtaattttttaacttctagtcatggcgaatgatcgcaggagagcacagactggaccctgctacgatctctcttggagtggatcagactgatgatcaccaacaaccaactcattcccggataaggaagaagagagtgtcacctacttcagtgtggtttcaaccctacttctgcatcttaaagacacttgtacaacgttggacactgtgcaggatgatgccacttcatcttggatgctaatctgccatgttgacttctgattaaccccaggcccaggaatgcctcaagatttctactttacttactgttgcttgtgtaagccaagacaaccttgatgttatcataaacatgtacttacctaagtcctgtcctttggcaaattatgggctatgagacacagcattcttgcctttccctgaggggtcaatttcagcgatcctacacattccttctgaagcacttatgctctttctatatggtatgtaagctctcggtctggggagtaacagtgcagagatctacctgtcttgttgccacatgtttctaaactttccaataaatcaccttctactgacaaaaaaaaaaagacttcct

SEQ ID NO: 301408 - DNA, 1544 bp, Homo sapiens
  misc_feature (5)..(5): n is a, c, g, or t
  misc_feature (8)..(8): n is a, c, g, or t
agcgngcntgcgtagccggcgggctggcagtgagactgactgcgtcggggttgagactgggtggatgaggctcaccccggcggggagaagggacgaggaggggcggacagcggaaggtccgggagtgtccgccataaagtcgtttgaggtgaccgttgcgtaattgtgagtctgtgagagaagatgtgaagtatggcctcgtcccggtcatctgggcgtgcgggtcccgggttttgatcgcgcgtttgtgtagttttaacttctagtcatggcgaatgatcgcaggagagcacagactggaccctgctacgatctctcttggagtggatcagactgatgatcaccaacaaccaactcattcccggataaggaagaagagagtgtcacctacttcagtgtggtttcaaccctacttctgcatcttaaagacactgtatggtttcagcagtagtgcccctgttcattagtccccctgatgttttcattcctcatctcatctttttcttagcagcattcaatgaatccttcattctagaaacactctatatctttggttttcatgagaccattctcaccttgttttgtcctgtgacttttttgaaaaaaacaaaaacaaaaaaccctttttttctttttaaattctggtaaaaaacacaatgaaaatttgctatcttaaccatgttgaaatgtgcagttagtaaagtacattcacattgtggtgcaagccatcactaccatccatcactagaacccttttcatcttgcagatctgaaactctacccattaaacaacttcccatcttcccatccccacagctcctagcaaccaacattctactttctctatcagtttgactactctaggtacctcatatgagtagaatcatacagcatttatccttctctgcctggcttatttcacttgtataatgtcctcaaggttcattcatgttgtagcatgcatcagaacttcctccccttttaaaggctggataatatttcatggtatgtttagatcacattctgtttatccattcatccatcagtgaacacttgtgctccttccaactttgggctgttgggtgtcctgccactgttgctcctagtgctcaatctcgtttattccctcctaatcaagtgtacaacgttggacactgtgcaggatgatgccacttcatcttggatgctaatctgccatgttgacttctgattaaccccaggcccaggaatgcctcaagatttctactttacttactgttgcttgtgtaagccaagacaaccttgatgttatcataaacatgtacttacctaagtcctgtcctttggcaaattatgggctatgagacacagcattcttgcctttccctgaggggtcaatttcagcgatcctacacattccttctgaagcacttatgctctttctatatggtatgtaagctctcggtctggggagtaacagtgcagagatctacctgtcttgttgccacatgtttctaaactttccaataaatcaccttctactgacaaaaaaaaaaagacttcct

SEQ ID NO: 301409 - DNA, 1412 bp, Homo sapiens
  misc_feature (14)..(14): n is a, c, g, or t
cgtcgaccggctgntagaagacgacagaagggggtgagtctgtgagagaagatgtgaagtatggcctcgtcccggtcatctgggcgtgcgggtcccgggttttgatcgcgcgtttgtgtagttttaacttctagtcatggcgaatgatcgcaggagagcacagactggaccctgctacgatctctcttggagtggatcagactgatgatcaccaacaaccaactcattcccggataaggaagaagagagtgtcacctacttcagtgtggtttcaaccctacttctgcatcttaaagacactgtatggtttcagcagtagtgcccctgttcattagtccccctgatgttttcattcctcatctcatctttttcttagcagcattcaatgaatccttcattctagaaacactctatatctttggttttcatgagaccattctcaccttgttttgtcctgtgacttttttgaaaaaaacaaaaacaaaaaaccctttttttctttttaaattctggtaaaaaacacaatgaaaatttgctatcttaaccatgttgaaatgtgcagttagtaaagtacattcacattgtggtgcaagccatcactaccatccatcactagaacccttttcatcttgcagatctgaaactctacccattaaacaacttcccatcttcccatccccacagctcctagcaaccaacattctactttctctatcagtttgactactctaggtacctcatatgagtagaatcatacagcatttatccttctctgcctggcttatttcacttgtataatgtcctcaaggttcattcatgttgtagcatgcatcagaacttcctccccttttaaaggctggataatatttcatggtatgtttagatcacattctgtttatccattcatccatcagtgaacacttgtgctccttccaactttgggctgttgggtgtcctgccactgttgctcctagtgctcaatctcgtttattccctcctaatcaagtgtacaacgttggacactgtgcaggatgatgccacttcatcttggatgctaatctgccatgttgacttctgattaaccccaggcccaggaatgcctcaagatttctactttacttactgttgcttgtgtaagccaagacaaccttgatgttatcataaacatgtacttacctaagtcctgtcctttggcaaattatgggctatgagacacagcattcttgcctttccctgaggggtcaatttcagcgatcctacacattccttctgaagcacttatgctctttctatatggtatgtaagctctcggtctggggagtaacagtgcagagatctacctgtcttgttgccacatgtttctaaactttccaataaatcaccttctactgacaaaaaaaaaaagacttcct

SEQ ID NO: 301410 - DNA, 1456 bp, Homo sapiens
  misc_feature (5)..(5): n is a, c, g, or t
  misc_feature (8)..(8): n is a, c, g, or t
agcgngcntgcgtagccggcgggctggcagtgagactgactgcgtcggggttgagactgggtggatgaggctcaccccggcggggagaagggacgaggaggggcggacagcggaaggtccgggagtgtccgccataaagtcgtttgaggtgaccgttgcgtaattttttaacttctagtcatggcgaatgatcgcaggagagcacagactggaccctgctacgatctctcttggagtggatcagactgatgatcaccaacaaccaactcattcccggataaggaagaagagagtgtcacctacttcagtgtggtttcaaccctacttctgcatcttaaagacactgtatggtttcagcagtagtgcccctgttcattagtccccctgatgttttcattcctcatctcatctttttcttagcagcattcaatgaatccttcattctagaaacactctatatctttggttttcatgagaccattctcaccttgttttgtcctgtgacttttttgaaaaaaacaaaaacaaaaaaccctttttttctttttaaattctggtaaaaaacacaatgaaaatttgctatcttaaccatgttgaaatgtgcagttagtaaagtacattcacattgtggtgcaagccatcactaccatccatcactagaacccttttcatcttgcagatctgaaactctacccattaaacaacttcccatcttcccatccccacagctcctagcaaccaacattctactttctctatcagtttgactactctaggtacctcatatgagtagaatcatacagcatttatccttctctgcctggcttatttcacttgtataatgtcctcaaggttcattcatgttgtagcatgcatcagaacttcctccccttttaaaggctggataatatttcatggtatgtttagatcacattctgtttatccattcatccatcagtgaacacttgtgctccttccaactttgggctgttgggtgtcctgccactgttgctcctagtgctcaatctcgtttattccctcctaatcaagtgtacaacgttggacactgtgcaggatgatgccacttcatcttggatgctaatctgccatgttgacttctgattaaccccaggcccaggaatgcctcaagatttctactttacttactgttgcttgtgtaagccaagacaaccttgatgttatcataaacatgtacttacctaagtcctgtcctttggcaaattatgggctatgagacacagcattcttgcctttccctgaggggtcaatttcagcgatcctacacattccttctgaagcacttatgctctttctatatggtatgtaagctctcggtctggggagtaacagtgcagagatctacctgtcttgttgccacatgtttctaaactttccaataaatcaccttctactgacaaaaaaaaaaagacttcct

SEQ ID NO: 301411 - DNA, 1656 bp, Homo sapiens
aaacaccacatattgtgatctcatttgtatgaaatgtcccgagtaggcaaatagataaacagaggaattagattggtggttgccaaggactggcgagagaagagaataaaaagtaatggctagtgggtaggatttctttagtcgttaaagtattctcaactattgtggtggctgttgcataactctgattataacaaggccactgaattttatgctgggattacaggcgtgagcaccatgcctggtggacattccattattaactcaccttggccttggaattaatgacttggagaagacctgaatggggaggggagagcagtagaagcatgagcctttctgactgtctacatgttcttgcccagttttaacttctagtcatggcgaatgatcgcaggagagcacagactggaccctgctacgatctctcttggagtggatcagactgatgatcaccaacaaccaactcattcccggataaggaagaagagagtgtcacctacttcagtgtggtttcaaccctacttctgcatcttaaagacactgtatggtttcagcagtagtgcccctgttcattagtccccctgatgttttcattcctcatctcatctttttcttagcagcattcaatgaatccttcattctagaaacactctatatctttggttttcatgagaccattctcaccttgttttgtcctgtgacttttttgaaaaaaacaaaaacaaaaaaccctttttttctttttaaattctggtaaaaaacacaatgaaaatttgctatcttaaccatgttgaaatgtgcagttagtaaagtacattcacattgtggtgcaagccatcactaccatccatcactagaacccttttcatcttgcagatctgaaactctacccattaaacaacttcccatcttcccatccccacagctcctagcaaccaacattctactttctctatcagtttgactactctaggtacctcatatgagtagaatcatacagcatttatccttctctgcctggcttatttcacttgtataatgtcctcaaggttcattcatgttgtagcatgcatcagaacttcctccccttttaaaggctggataatatttcatggtatgtttagatcacattctgtttatccattcatccatcagtgaacacttgtgctccttccaactttgggctgttgggtgtcctgccactgttgctcctagtgctcaatctcgtttattccctcctaatcaagtgtacaacgttggacactgtgcaggatgatgccacttcatcttggatgctaatctgccatgttgacttctgattaaccccaggcccaggaatgcctcaagatttctactttacttactgttgcttgtgtaagccaagacaaccttgatgttatcataaacatgtacttacctaagtcctgtcctttggcaaattatgggctatgagacacagcattcttgcctttccctgaggggtcaatttcagcgatcctacacattccttctgaagcacttatgctctttctatatggtatgtaagctctcggtctggggagtaacagtgcagagatctacctgtcttgttgccacatgtttctaaactttccaataaatcaccttctactgacaaaaaaaaaaagacttcct

SEQ ID NO: 301412 - DNA, 1346 bp, Homo sapiens
ggcgacatggccaaacgtaccaagaaagtcgggttttgatcgcgcgtttgtgtagttttaacttctagtcatggcgaatgatcgcaggagagcacagactggaccctgctacgatctctcttggagtggatcagactgatgatcaccaacaaccaactcattcccggataaggaagaagagagtgtcacctacttcagtgtggtttcaaccctacttctgcatcttaaagacactgtatggtttcagcagtagtgcccctgttcattagtccccctgatgttttcattcctcatctcatctttttcttagcagcattcaatgaatccttcattctagaaacactctatatctttggttttcatgagaccattctcaccttgttttgtcctgtgacttttttgaaaaaaacaaaaacaaaaaaccctttttttctttttaaattctggtaaaaaacacaatgaaaatttgctatcttaaccatgttgaaatgtgcagttagtaaagtacattcacattgtggtgcaagccatcactaccatccatcactagaacccttttcatcttgcagatctgaaactctacccattaaacaacttcccatcttcccatccccacagctcctagcaaccaacattctactttctctatcagtttgactactctaggtacctcatatgagtagaatcatacagcatttatccttctctgcctggcttatttcacttgtataatgtcctcaaggttcattcatgttgtagcatgcatcagaacttcctccccttttaaaggctggataatatttcatggtatgtttagatcacattctgtttatccattcatccatcagtgaacacttgtgctccttccaactttgggctgttgggtgtcctgccactgttgctcctagtgctcaatctcgtttattccctcctaatcaagtgtacaacgttggacactgtgcaggatgatgccacttcatcttggatgctaatctgccatgttgacttctgattaaccccaggcccaggaatgcctcaagatttctactttacttactgttgcttgtgtaagccaagacaaccttgatgttatcataaacatgtacttacctaagtcctgtcctttggcaaattatgggctatgagacacagcattcttgcctttccctgaggggtcaatttcagcgatcctacacattccttctgaagcacttatgctctttctatatggtatgtaagctctcggtctggggagtaacagtgcagagatctacctgtcttgttgccacatgtttctaaactttccaataaatcaccttctactgacaaaaaaaaaaagacttcct

SEQ ID NO: 301413 - DNA, 1573 bp, Homo sapiens
  misc_feature (5)..(5): n is a, c, g, or t
  misc_feature (8)..(8): n is a, c, g, or t
agcgngcntgcgtagccggcgggctggcagtgagactgactgcgtcggggttgagactgggtggatgaggctcaccccggcggggagaagggacgaggaggggcggacagcggaaggtccgggagtgtccgccataaagtcgtttgaggtgaccgttgcgtaattgtgagtctgtgagagaagatgtgaagtatggcctcgtcccggtcatctgggcgtgcgggtcccgggttttgatcgcgcgtttgtgtagttttaacttctagtcatggcgaatgatcgcaggagagcacagactggaccctgctacgatctctcttggagtggatcagactgatgatcaccaacaaccaactcattcccggataaggaagaagagagtgtcacctacttcagtgtggtttcaaccctacttctgcatcttaaagacactgtatggtttcagcagtagtgcccctgttcattagtccccctgatgttttcattcctcatctcatctttttcttagcagcattcaatgaatccttcattctagaaacactctatatctttggttttcatgagaccattctcaccttgttttgtcctgtgacttttttgaaaaaaacaaaaacaaaaaaccctttttttctttttaaattctggtaaaaaacacaatgaaaatttgctatcttaaccatgttgaaatgtgcagttagtaaagtacattcacattgtggtgcaagccatcactaccatccatcactagaacccttttcatcttgcagatctgaaactctacccattaaacaacttcccatcttcccatccccacagctcctagcaaccaacattctactttctctatcagtttgactactctaggtacctcatatgagtagaatcatacagcatttatccttctctgcctggcttatttcacttgtataatgtcctcaaggttcattcatgttgtagcatgcatcagaacttcctccccttttaaaggctggataatatttcatggtatgtttagatcacattctgtttatccattcatccatcagtgaacacttgtgctccttccaactttgggctgttgggtgtcctgccactgttgctcctagtgctcaatctcgtttattccctcctaatcaagtgtacaacgttggacactgtgcaggatgatgccacttcatcttggatgctaatctgccatgttgacttctgattaaccccaggcccaggaatgcctcaagatttctactttacttactgttgcttgtgtaagccaagacaaccttgatgttatcataaacatgtacttacctaagtcctgtcctttggcaaattatgggctatgagacacagcattcttgcctttccctgaggggtcaatttcagcgatcctacacattccttctgaagcacttatgctctttctatatggtatgtaagctctcggtctggggagtaacagtgcagagatctacctgtcttgttgccacatgtttctaaactttccaataaatcaccttgccagatgcggccgaaggagaacgtatacaggtcgacgtgaaccgatccaaaacat

SEQ ID NO: 301414 - DNA, 839 bp, Homo sapiens
  misc_feature (5)..(5): n is a, c, g, or t
  misc_feature (8)..(8): n is a, c, g, or t
agcgngcntgcgtagccggcgggctggcagtgagactgactgcgtcggggttgagactgggtggatgaggctcaccccggcggggagaagggacgaggaggggcggacagcggaaggtccgggagtgtccgccataaagtcgtttgaggtgaccgttgcgtaattgtgagtctgtgagagaagatgtgaagtatggcctcgtcccggtcatctgggcgtgcgggtcccgggttttgatcgcgcgtttgtgtagttttaacttctagtcatggcgaatgatcgcaggagagcacagactggaccctgctacgatctctcttggagtggatcagactgatgatcaccaacaaccaactcattcccggataaggaagaagagagtgtcacctacttcagtgtggtttcaaccctacttctgcatcttaaagacacttgtacaacgttggacactgtgcaggatgatgccacttcatcttggatgctaatctgccatgttgacttctgattaaccccaggcccaggaatgcctcaagatttctactttacttactgttgcttgtgtaagccaagacaaccttgatgttatcataaacatgtacttacctaagtcctgtcctttggcaaattatgggctatgagacacagcattcttgcctttccctgaggggtcaatttcagcgatcctacacattccttctgaagcacttatgctctttctatatggtatgtaagctctcggtctggggagtaacagtgcagagatctacctgtcttgttgccacatgtttctaaactttccaataaatcaccttctactgacaaaaaaaaaaagacttcct

SEQ ID NO: 301415 - DNA, 589 bp, Homo sapiens
ggcgactatagaggacccgcccaggtagaaaggctggataatatttcatggtatgtttagatcacattctgtttatccattcatccatcagtgaacacttgtgctccttccaactttgggctgttgggtgtcctgccactgttgctcctagtgctcaatctcgtttattccctcctaatcaagtgtacaacgttggacactgtgcaggatgatgccacttcatcttggatgctaatctgccatgttgacttctgattaaccccaggcccaggaatgcctcaagatttctactttacttactgttgcttgtgtaagccaagacaaccttgatgttatcataaacatgtacttacctaagtcctgtcctttggcaaattatgggctatgagacacagcattcttgcctttccctgaggggtcaatttcagcgatcctacacattccttctgaagcacttatgctctttctatatggtatgtaagctctcggtctggggagtaacagtgcagagatctacctgtcttgttgccacatgtttctaaactttccaataaatcaccttctactgacaaaaaaaaaaagacttcct

SEQ ID NO: 301416 - DNA, 605 bp, Homo sapiens
tcttctccgaaaggcaacatctgcgcacctgctagcatctttattaaggctggataatatttcatggtatgtttagatcacattctgtttatccattcatccatcagtgaacacttgtgctccttccaactttgggctgttgggtgtcctgccactgttgctcctagtgctcaatctcgtttattccctcctaatcaagtgtacaacgttggacactgtgcaggatgatgccacttcatcttggatgctaatctgccatgttgacttctgattaaccccaggcccaggaatgcctcaagatttctactttacttactgttgcttgtgtaagccaagacaaccttgatgttatcataaacatgtacttacctaagtcctgtcctttggcaaattatgggctatgagacacagcattcttgcctttccctgaggggtcaatttcagcgatcctacacattccttctgaagcacttatgctctttctatatggtatgtaagctctcggtctggggagtaacagtgcagagatctacctgtcttgttgccacatgtttctaaactttccaataaatcaccttctactgacaaaaaaaaaaagacttcct

SEQ ID NO: 301417 - DNA, 4107 bp, Homo sapiens
gcagcttgcggtggcgaaggcggctttagtggcagcatgaagcgcaccccgactgccgaggaacgagagcgcgaagctaagaaactgaggcttcttgaagagcttgaagacacttggctcccttatctgacccccaaagatgatgaattctatcagcagtggcagctgaaatatcctaaactaattctccgagaagccagcagtgtatctgaggagctccataaagaggttcaagaagcctttctcacactgcacaagcatggctgcttatttcgggacctggttaggatccaaggcaaagatctgctcactccggtatctcgcatcctcattggtaatccaggctgcacctacaagtacctgaacaccaggctctttacggtcccctggccagtgaaagggtctaatataaaacacaccgaggctgaaatagccgctgcttgtgagaccttcctcaagctcaatgactacctgcagatagaaaccatccaggctttggaagaacttgctgccaaagagaaggctaatgaggatgctgtgccattgtgtatgtctgcagatttccccagggttgggatgggttcatcctacaacggacaagatgaagtggacattaagagcagagcagcatacaacgtaactttgctgaatttcatggatcctcagaaaatgccatacctgaaagaggaaccttattttggcatggggaaaatggcagtgagctggcatcatgatgaaaatctggtggacaggtcagcggtggcagtgtacagttatagctgtgaaggccctgaagaggaaagtgaggatgactctcatctcgaaggcagggatcctgatatttggcatgttggttttaagatctcatgggacatagagacacctggtttggcgataccccttcaccaaggagactgctatttcatgcttgatgatctcaatgccacccaccaacactgtgttttggccggttcacaacctcggtttagttccacccaccgagtggcagagtgctcaacaggaaccttggattatattttacaacgctgtcagttggctctgcagaatgtctgtgacgatgtggacaatgatgatgtctctttgaaatcctttgagcctgcagttttgaaacaaggagaagaaattcataatgaggtcgagtttgagtggctgaggcagttttggtttcaaggcaatcgatacagaaagtgcactgactggtggtgtcaacccatggctcaactggaagcactgtggaagaagatggagggtgtgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagagattaaatgaaataaatgaaataacatagaccaggagggcgtggtgtttaaaagtcacagatggggcaccctcgggccatccagcccagtgttttctttagcccctatgatgttcattttttgttatatcccattaggtgcccatatttaaaaattgggagatttcacataaaattaaaaggtctgcattttcttttttcttttcttttttttttttttgagacacagtctcactctgtcaccaggctagagtgcagtggcacgatctcagctcactgcaacctctgcctcccaggttcaagtaattctcctgcctcagcctcccaagtagctgggactacaggcacgtgccaccacgcccagctaatttttgtatttttagcagagatggggtttcaccacattggccaggatggtctcgatctcaacctcgtgatccacccacctcggtctcccaaagcgctgggattacaggcgtgagccaccgcgccaagccaaggtctgcatttttctttagaactcagaacacccaatagtcctaggcccccatcctcgcatggcagcaagctaaataagcatcttcccactgcgagttggggcatgacccagcctatggtttgccatactccctctttttctccgttttttcattaattgtgaacctgacctgcatcaccctttcatgtcagtgctctccaaacctgcttgcttgcacccctctagtcgaaatattttgtgcttaccccaatatatgtgtgtgactattgaactctattcgtagactgcttgtactaatgtcatttgcatcataaaatattcatatccaataaacatattaaaaggatgagataagaaaccgaga

SEQ ID NO: 301418 - DNA, 4124 bp, Homo sapiens
gcagcttgcggtggcgaaggcggctttagtggcagcatgaagcgcaccccgactgccgaggaacgagagcgcgaagctaagaaactgaggcttcttgaagagcttgaagacacttggctcccttatctgacccccaaagatgatgaattctatcagcagtggcagctgaaatatcctaaactaattctccgagaagccagcagtgtatctgaggagctccataaagaggttcaagaagcctttctcacactgcacaagcatggctgcttatttcgggacctggttaggatccaaggcaaagatctgctcactccggtatctcgcatcctcattggtaatccaggctgcacctacaagtacctgaacaccaggctctttacggtcccctggccagtgaaagggtctaatataaaacacaccgaggctgaaatagccgctgcttgtgagaccttcctcaagctcaatgactacctgcagatagaaaccatccaggctttggaagaacttgctgccaaagagaaggctaatgaggatgctgtgccattgtgtatgtctgcagatttccccagggttgggatgggttcatcctacaacggacaagatgaagtggacattaagagcagagcagcatacaacgtaactttgctgaatttcatggatcctcagaaaatgccatacctgaaagaggaaccttattttggcatggggaaaatggcagtgagctggcatcatgatgaaaatctggtggacaggtcagcggtggcagtgtacagttatagctgtgaaggccctgaagaggaaagtgaggatgactctcatctcgaaggcagggatcctgatatttggcatgttggttttaagatctcatgggacatagagacacctggtttggcgataccccttcaccaaggagactgctatttcatgcttgatgatctcaatgccacccaccaacactgtgttttggccggttcacaacctcggtttagttccacccaccgagtggcagagtgctcaacaggaaccttggattatattttacaacgctgtcagttggctctgcagaatgtctgtgacgatgtggacaatgatgatgtctctttgaaatcctttgagcctgcagttttgaaacaaggagaagaaattcataatgaggtcgagtttgagtggctgaggcagttttggtttcaaggcaatcgatacagaaagtgcactgactggtggtgtcaacccatggctcaactggaagcactgtggaagaagatggagggtgtgacaaatgctgtgcttcatgaagttaaaagagaggggctccccgtggaacaaaggaatgaaatcttgactgccatccttgcctcgctcactgcacgccagaacctgaggagagaatggcatgccagggcagagaggagtgttggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagagattaaatgaaataaatgaaataacatagaccaggagggcgtggtgtttaaaagtcacagatggggcaccctcgggccatccagcccagtgttttctttagcccctatgatgttcattttttgttatatcccattaggtgcccatatttaaaaattgggagatttcacataaaattaaaaggtctgcattttcttttttcttttcttttttttttttttgagacacagtctcactctgtcaccaggctagagtgcagtggcacgatctcagctcactgcaacctctgcctcccaggttcaagtaattctcctgcctcagcctcccaagtagctgggactacaggcacgtgccaccacgcccagctaatttttgtatttttagcagagatggggtttcaccacattggccaggatggtctcgatctcaacctcgtgatccacccacctcggtctcccaaagcgctgggattacaggcgtgagccaccgcgccaagccaaggtctgcatttttctttagaactcagaacacccaatagtcctaggcccccatcctcgcatggcagcaagctaaataagcatcttcccactgcgagttggggcatgacccagcctatggtttgccatactccctctttttctccgttttttcattaattgtgaacctgacctgcatcaccctttcatgtcagtgctctccaaacctgcttgcttgcacccctctagtcgaaatattttgtgcttaccccaatatatgtgtgtgactattgaactctattcgtagactgcttgtactaatgtcatttgcatcataaaatattcatatccaataaacatattaaaaggatgagataagaaaccgaga

SEQ ID NO: 301419 - DNA, 3065 bp, Homo sapiens
ggctggtccggtccggaatcttagcggataagctgtggtggctccacgtttctttagcgggcaggttttatatatataggttaagattatcaccagctcctcctggcccatgggtcgagtttgagtggctgaggcagttttggtttcaaggcaatcgatacagaaagtgcactgactggtggtgtcaacccatggctcaactggaagcactgtggaagaagatggagggtgtgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagagattaaatgaaataaatgaaataacatagaccaggagggcgtggtgtttaaaagtcacagatggggcaccctcgggccatccagcccagtgttttctttagcccctatgatgttcattttttgttatatcccattaggtgcccatatttaaaaattgggagatttcacataaaattaaaaggtctgcattttcttttttcttttcttttttttttttttgagacacagtctcactctgtcaccaggctagagtgcagtggcacgatctcagctcactgcaacctctgcctcccaggttcaagtaattctcctgcctcagcctcccaagtagctgggactacaggcacgtgccaccacgcccagctaatttttgtatttttagcagagatggggtttcaccacattggccaggatggtctcgatctcaacctcgtgatccacccacctcggtctcccaaagcgctgggattacaggcgtgagccaccgcgccaagccaaggtctgcatttttctttagaactcagaacacccaatagtcctaggcccccatcctcgcatggcagcaagctaaataagcatcttcccactgcgagttggggcatgacccagcctatggtttgccatactccctctttttctccgttttttcattaattgtgaacctgacctgcatcaccctttcatgtcagtgctctccaaacctgcttgcttgcacccctctagtcgaaatattttgtgcttaccccaatatatgtgtgtgactattgaactctattcgtagactgcttgtactaatgtcatttgcatcataaaatattcatatccaataaacatattaaaaggatgagataagaaaccgaga

SEQ ID NO: 301420 - DNA, 3041 bp, Homo sapiens
caaagtagggtgacctagtctgaaggacaggcgcagaacagtcagtggaacagccagagatagcagcgagagaggtgagaagaggaccaggagtaggtggtagaatggagtggaggaaagtcagcgaatgtaatagtgtcgaaccctgcagggaagttaagaagtggccataccgttgcattcatcatgggaagaatttcagtagaatgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagagattaaatgaaataaatgaaataacatagaccaggagggcgtggtgtttaaaagtcacagatggggcaccctcgggccatccagcccagtgttttctttagcccctatgatgttcattttttgttatatcccattaggtgcccatatttaaaaattgggagatttcacataaaattaaaaggtctgcattttcttttttcttttcttttttttttttttgagacacagtctcactctgtcaccaggctagagtgcagtggcacgatctcagctcactgcaacctctgcctcccaggttcaagtaattctcctgcctcagcctcccaagtagctgggactacaggcacgtgccaccacgcccagctaatttttgtatttttagcagagatggggtttcaccacattggccaggatggtctcgatctcaacctcgtgatccacccacctcggtctcccaaagcgctgggattacaggcgtgagccaccgcgccaagccaaggtctgcatttttctttagaactcagaacacccaatagtcctaggcccccatcctcgcatggcagcaagctaaataagcatcttcccactgcgagttggggcatgacccagcctatggtttgccatactccctctttttctccgttttttcattaattgtgaacctgacctgcatcaccctttcatgtcagtgctctccaaacctgcttgcttgcacccctctagtcgaaatattttgtgcttaccccaatatatgtgtgtgactattgaactctattcgtagactgcttgtactaatgtcatttgcatcataaaatattcatatccaataaacatattaaaaggatgagataagaaaccgaga

SEQ ID NO: 301421 - DNA, 2214 bp, Homo sapiens
gtgcggcctcgggtggtaaatcaggcgaccggggcaagagatttagatgaatccagtgtggtactctcgcacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagagattaaatgaaataaatgaaataacatagaccaggagggcgtggtgtttaaaagtcacagatggggcaccctcgggccatccagcccagtgttttctttagcccctatgatgttcattttttgttatatcccattaggtgcccatatttaaaaattgggagatttcacataaaattaaaaggtctgcattttcttttttcttttcttttttttttttttgagacacagtctcactctgtcaccaggctagagtgcagtggcacgatctcagctcactgcaacctctgcctcccaggttcaagtaattctcctgcctcagcctcccaagtagctgggactacaggcacgtgccaccacgcccagctaatttttgtatttttagcagagatggggtttcaccacattggccaggatggtctcgatctcaacctcgtgatccacccacctcggtctcccaaagcgctgggattacaggcgtgagccaccgcgccaagccaaggtctgcatttttctttagaactcagaacacccaatagtcctaggcccccatcctcgcatggcagcaagctaaataagcatcttcccactgcgagttggggcatgacccagcctatggtttgccatactccctctttttctccgttttttcattaattgtgaacctgacctgcatcaccctttcatgtcagtgctctccaaacctgcttgcttgcacccctctagtcgaaatattttgtgcttaccccaatatatgtgtgtgactattgaactctattcgtagactgcttgtactaatgtcatttgcatcataaaatattcatatccaataaacatattaaaaggatgagataagaaaccgaga

SEQ ID NO: 301422 - DNA, 1698 bp, Homo sapiens
ggtagtaactcctccagggccacatgcaacccctaagtctgaggcacaactattacttctgtcggtggatgctatacaagcatatttaaggctatattcactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagagattaaatgaaataaatgaaataacatagaccaggagggcgtggtgtttaaaagtcacagatggggcaccctcgggccatccagcccagtgttttctttagcccctatgatgttcattttttgttatatcccattaggtgcccatatttaaaaattgggagatttcacataaaattaaaaggtctgcattttcttttttcttttcttttttttttttttgagacacagtctcactctgtcaccaggctagagtgcagtggcacgatctcagctcactgcaacctctgcctcccaggttcaagtaattctcctgcctcagcctcccaagtagctgggactacaggcacgtgccaccacgcccagctaatttttgtatttttagcagagatggggtttcaccacattggccaggatggtctcgatctcaacctcgtgatccacccacctcggtctcccaaagcgctgggattacaggcgtgagccaccgcgccaagccaaggtctgcatttttctttagaactcagaacacccaatagtcctaggcccccatcctcgcatggcagcaagctaaataagcatcttcccactgcgagttggggcatgacccagcctatggtttgccatactccctctttttctccgttttttcattaattgtgaacctgacctgcatcaccctttcatgtcagtgctctccaaacctgcttgcttgcacccctctagtcgaaatattttgtgcttaccccaatatatgtgtgtgactattgaactctattcgtagactgcttgtactaatgtcatttgcatcataaaatattcatatccaataaacatattaaaaggatgagataagaaaccgaga

SEQ ID NO: 301423 - DNA, 1695 bp, Homo sapiens
gcagcttgcggtggcgaaggcggctttagtggcagcatgaagcgcaccccgactgccgaggaacgagagcgcgaagctaagaaactgaggcttcttgaagagcttgaagacacttggctcccttatctgacccccaaagatgatgaattctatcagcagtggcagctgaaatatcctaaactaattctccgagaagccagcagtgtatctgaggagctccataaagaggttcaagaagcctttctcacactgcacaagcatggctgcttatttcgggacctggttaggatccaaggcaaagatctgctcactccggtatctcgcatcctcattggtaatccaggctgcacctacaagtacctgaacaccaggctctttacggtcccctggccagtgaaagggtctaatataaaacacaccgaggctgaaatagccgctgcttgtgagaccttcctcaagctcaatgactacctgcagatagaaaccatccaggctttggaagaacttgctgccaaagagaaggctaatgaggatgctgtgccattgtgtatgtctgcagatttccccagggttgggatgggttcatcctacaacggacaagatgaagtggacattaagagcagagcagcatacaacgtaactttgctgaatttcatggatcctcagaaaatgccatacctgaaagaggaaccttattttggcatggggaaaatggcagtgagctggcatcatgatgaaaatctggtggacaggtcagcggtggcagtgtacagttatagctgtgaaggccctgaagaggaaagtgaggatgactctcatctcgaaggcagggatcctgatatttggcatgttggttttaagatctcatgggacatagagacacctggtttggcgataccccttcaccaaggagactgctatttcatgcttggtaatctttggaaaatcaaaattatattgaaactctagtgtctaaatttagattataggatttatattttgagtatgtcttatgaaataaacttttggagtattttatattaagagcgaaacttctttataagaacatgtaactaggtttttcttttttgagatattgctgattttttgagatggagcttcacttccggcttgagcaacagagcaagactcagtctcaaaaaaaaaaaaaaaaaaaaagtaaataagtactctaaaaattcagctatattccatatatttaataacatcttgtgtgttcttttctgattaaaaaagcaatatgtgcttatttgagagaaaagaaactctggaaaaaagagtctgaaatgaagaaagaatataaaaatcaggttaatgcctgatttaatatatttcttttcagtctttttctgtatatgtatgtctggaattatagtagtaatatgaataaaaccagatttactgggaattaatgacaaacattcttttaatcttctcagcaatcctgagaaacaaatattagctatactgcaaaagaggaaattgaggttaaatttatgtagttacttaaccgtggctgcacagctagtaagaagcatggattgtatcttgtcatcttatcccactcggggtctgacatcccatgtcaggccagccctccttctcccgtagggatgccctcctcaccctactcagcgctgaacgctgctcagggttcctgtgccttcttcttcc

SEQ ID NO: 301424 - DNA, 603 bp, Homo sapiens
tttaggtgagggaaactcattttaaaatgaaaacctcaaaggtaaaataaattcgtctaatatgttcactaaatatttttacttattttgacaagaaatgcatttttgtttcttacctgtattataggatattcaccttgcgaaacgtttttatgacatggcagctgaagccagcccagatgcacaagttccagtcttcctagccctctgcaaattgggcgtcgtctatttcttgcagtacatacgggaaacaaacgtaagtggtccgtacctcttttcattaaaatataaatgatggaaggtctgtcctggaggtttgtttttcaaaagttgagaagcacagggaagagtggtcctgcaggtatcgggtgtgttcccttctcctcagctcaggtacccgaggaccttatcaggggagggataaatgcaggcataaagcagctactgcagtttttaggtagcgtttgacacttcctgacgctaaagcatttttcatggaggcagatgttttctggtttagggaaaactgagactaactcatggcagtttgaaacagtatttaattcagtaaacattaaatcagatgactcaaaccagtccctt

SEQ ID NO: 301425 - DNA, 7901 bp, Homo sapiens
  misc_feature (7013)..(7013): n is a, c, g, or t
aagagcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcggatgaagaaggcagccaggatgaatccttagattccaagactactttgacatcagatgagtcagtaaaggaccatactactgcaggcagagtagttgctggtcaaatatttcttgattcagaagaatctgaattagaatcctctattcaagaagaggaagacagcctcaagagccaagagggggaaagtgtcacagaagatatcagctttctagagtctccaaatccagaaaacaaggactatgaagagccaaagaaagtacggaaaccagctttgaccgccattgaaggcacagcacatggggagccctgccacttcccttttcttttcctagataaggagtatgatgaatgtacatcagatgggagggaagatggcagactgtggtgtgctacaacctatgactacaaagcagatgaaaagtggggcttttgtgaaactgaagaagaggctgctaagagacggcagatgcaggaagcagaaatgatgtatcaaactggaatgaaaatccttaatggaagcaataagaaaagccaaaaaagagaagcatatcggtatctccaaaaggcagcaagcatgaaccataccaaagccctggagagagtgtcatatgctcttttatttggtgattacttgccacagaatatccaggcagcgagagagatgtttgagaagctgactgaggaaggctctcccaagggacagactgctcttggctttctgtatgcctctggacttggtgttaattcaagtcaggcaaaggctcttgtatattatacatttggagctcttgggggcaatctaatagcccacatggttttgggttacagatactgggctggcatcggcgtcctccagagttgtgaatctgccctgactcactatcgtcttgttgccaatcatgttgctagtgatatctcgctaacaggaggctcagtagtacagagaatacggctgcctgatgaagtggaaaatccaggaatgaacagtggaatgctagaagaagatttgattcaatattaccagttcctagctgaaaaaggtgatgtacaagcacaggttggtcttggacaactgcacctgcacggagggcgtggagtagaacagaatcatcagagagcatttgactacttcaatttagcagcaaatgctggcaattcacatgccatggcctttttgggaaagatgtattcggaaggaagtgacattgtacctcagagtaatgagacagctctccactactttaagaaagctgctgacatgggcaacccagttggacagagtgggcttggaatggcctacctctatgggagaggagttcaagttaattatgatctagcccttaagtatttccagaaagctgctgaacaaggctgggtggatgggcagctacagcttggttccatgtactataatggcattggagtcaagagagattataaacaggccttgaagtattttaatttagcttctcagggaggccatatcttggctttctataacctagctcagatgcatgccagtggcaccggcgtgatgcgatcatgtcacactgcagtggagttgtttaagaatgtatgtgaacgaggccgttggtctgaaaggcttatgactgcctataacagctataaagatggcgattacaatgctgcagtgatccagtacctcctcctggctgaacagggctatgaagtggcacaaagcaatgcagcctttattcttgatcagagagaagcaagcattgtaggtgagaatgaaacttatcccagagctttgctacattggaacagggccgcctctcaaggctatactgtggctagaattaagctcggagactaccatttctatgggtttggcaccgatgtagattatgaaactgcatttattcattaccgtctggcttctgagcagcaacacagtgcacaagctatgtttaatctgggatatatgcatgagaaaggactgggcattaaacaggatattcaccttgcgaaacgtttttatgacatggcagctgaagccagcccagatgcacaagttccagtcttcctagccctctgcaaattgggcgtcgtctatttcttgcagtacatacgggaaacaaacattcgagatatgttcacccaacttgatatggaccagcttttgggacctgagtgggacctttacctcatgaccatcattgcgctgctgttgggaacagtcatagcttacaggcaaaggcagcaccaagacatgcctgcacccaggcctccagggccacggccagctccaccccagcaggaggggccaccagagcagcagccaccacagtaataggcactgggtccagccttgatcagtgacagcgaaggaagttatctgctgggaacacttgcatttgatttaggaccttggatcagtggtcacctcccagaagaggcacggcacaaggaagcattgaattcctaaagctgcttagaatctgatgcctttattttcagggataagtaactcttacctaaactgagctgaatgtttgtttcagtgccatatggaataacaactttcagtggcttttttttttcttttctggaaacatatgtgagacactcagagtaatgtctactgtatccagctatctttcttggatccttttggtcattatttcagtgtgcataagttcttaatgtcaaccatctttaaggtattgtgcatcgacactaaaaactgatcagtgtaaaaaggaaaacccagttgcaagtttaaacgtgttcgaaagtctgaaaatagaacttgccttttaagttaaaaaaaaaaaaagctatcttgaaaatgttttggaactgcgataactgagaaactcttaccagtccacatgcaattagacatattcagcatatttgttattttaaaagggagggttgggaggtttcttattggtgattgtcacacggtataccatactcctctccttcaaagaatgaaaggccttgttaaggagttttttgtgagctttacttctttggaatggaatatacttatgcaaaaccttgtgaactgactccttgcactaacgcgagtttgccccacctactctgtaatttgcttgtttgttttgaatatacagagccttgatccagaagccagaggatggactaagtgggagaaattagaaaacaaaacgaactctggttggggtactacgatcacagacacagacatacttttcctaaagttgaagcatttgttcccaggatttattttactttgcatttctttttgcacaaagaacacatcaccttcctgaattctttaaatatgaaatatcattgccagggtatggcttacagtgactactattataatactaaaactcagagaatcaaagatggattaaactcagtggttgatgaaagccaaaacctgtttgtactgttctatactattcaggtatctttttatttctgatagttttatattataatagaaagccagccactgcttagctatcatagtcaccattttctcactgttaacattaggaaaatcaaggctactatgcttcaggattgtctggttaaatagtatgggaaaaaaactgaagagtttcacataattacacacgtgaaataattaaagcttaaactgaatttgtatttcattttattgtcagatggtggtgttcaccagcctgtatcttgtctgagactgcattcgtatctgagcaggttttctatgcctactgatgtcagtatgtttatactaaccttcatgcttttttcccagaatccctcatctgccagaaaacttgaaaagtttattgcttgtagagttgtactgctttgatttttgaagttggggtagtagttagaactagatttaactagtctataatgaacatgaaggcttttatatatgaagttgtatacctttttgtgtttagagaattatgggaaacctggtaagcaaaactttcctcccagataattgcttccaaattcgaagagttagtcaccaagagagccatatgtatgaaagcgtatctgtgaaaggtaggaaacttaccccccctaagtgtaatgttgctttaggcaactcttgtaaatagtgagacttgtttggtctcttacatgtagagatttgagtgcagttggtacagtactttggtgtctccaccactgtcccttctccccgcttcaaaataagtgtaatccacggtagcagccacacttccttcagaaggaactgttataatttatttaaaagttgaaaaaccacccaagatgactaccaactttcacttttttcttctgccatccaccctcatttttcctttagcaagatttttatatctaactttccttccctccattgagtacgtgctttgagaaaacatttcttaaaacagtgtgtgccacctaaggctggatgggaaagtgcagtcttgttgttcatataaaaacacacttcttattagtttaccacttgcctttttctattgttaatgttctgaatttccttttcttggcttgtttctacttcattttaccctgggtcacttgctgccagcagtttgtgaatggtgtctttcaaataacttagttcttatggcttcacttaaagactgtctcaaaaatactttgctctcttcttcttttttgttcatgggacatggtacctaagcaaataggagttgggtttggtttttctcctaaaataatgctcaatacttacctaatcaaatggcatccatttgaataaaatgacaataactaaagctagttaatgtcagtgacattaaactaactccaggattcaggagttttaatgttagaatttagatttaacagatagagtgtggcttcatttgtccatggtagcccatctctcctaagaccttttctagtctgtcttcctgccttcgaacttgatgacagtaaaaccctgtttagtattctcttgtgcatttggtttgttggttagccgactgtcttgaaactattcattttgcttctagttttattttacagaggtagcattggtgggtttttttttttttttctgtctctgtgtttgaagtttcagtttctgttttctaggtaaggcttatttttgattagcagtcaatggcaaagaaaaagtaaatcaaagatgacttcttttcaaaatgtattgtttagcacttaactcagatgaatttataaattattaatcttgatactaaggatttgttacttttttgcatattaggttaatttttaccttacatgtgagagtcttaccactaagccattctgtctctgtactgttgggaagttttggaaacccctgccagtgatctggtgatgatctgatgatttatttaaagagccgttgatgcctccaggaaacttaagtattttattaatatatatataggaatttttttttattttgctttgtctttctctcccttcttttatcctcatgttcattcttcaaaccagtgttttggaagtatgcatgcaggcctataaatgaaaaacacaattctttatgtgtatagcatgtgtattaatgtctaactacatacgcaaaaacttcctttacagaggttcggactaacatttcacatgcacatttcaaaacaagatgtgtcatgaaaacagcccctttacctgccaagacaagcagggctatatttcagtgacagctgatatttgttttgaaagtgaatctcataatatatatatgtattacacattattatgactagaagtatgtaagaaatgatcagaacaaaagaaaatttctattttcatgcaaatatttttcatcagtcatcactctcaaatataaattaaaatataacactcctgaatgcctgaggcacgatctggattttaaatgtgtggtattcattgaaaagaagctctccacccacttggtatttcaagaaaatttaaaacgatcccaaggaaagatgatttgtatgttaaagtgactgcacaagtaaaagtccaatgttgtgtgcatgaaaaggattccttggttatgtgcagggaatcatctcacatgctgtttttcctatttggtttgagaaacaggctgacactattctctttgattagaaaataaactcataaaactcataatgttgatataatcaagatgtaaccactataaatatgtagaagaggaagttttaaaagaccttaagctggcattgtgaaggaacaccatggtagactctttttgtaaatgtattttgtatttaatgaaatgcagtataaaggttggtgaagtgtaatataattgtgtaaacaaatcctgttaatagagagatgtacagaatcgttttgtactgtatcttgaaacttgtgaaataaagattccacctctggttatcctgtatgctgtaatataccacaaccaagcacctttccagacagactttttttaagctgaatgattcaattttttaatgttttttggaaattcagaagcttctgaaaacattcacttgtggcaatttgaatttatctttcattttaaactcctgaaattcagatttttacaagtccaatattgccctagggagaacatgaatttgctaagaaatgttatcttttaaatctctgatatctttgtcttgaagcagccttgatatgtagtaagcgtgattcactttagcctgattataatattatttatctaaagtttgtttatgcattgccttgtcccaggaattttttaagaggacttgcagagacacgtaccacacagtaacatttagactaaatatgctctgagtaaaggagaaatgaaaaaatattaaatcaagagtgaacatgtacacaaagtgcaattggaagtgggctacaaatttngcccccagcttcccagcaggcaactcaaagaggtaactgaggtaaaatgttccagctcagaagcattggatcttggataaaaagcctacatgatgcaaactgtggcaactgagatgtcagatctcaagatctcaaattgtacttgtgggagcacagtcagtgaccccagatgaccttgactgacctaaaagttgtgggggaagtcggatgtcagagccttaacaccagcaggtgaccatccaacctggggcaatgcctgcctgttcaccacttagcctctttctggcaagtcattagaatgtcctccatcttcattggctgcaacttgatgagctacagcctctttcctaacttcctttatgatgctagtttaggttggttataccagcttggaagtatgcttagattaagttacagcagatacacaaattagatgcaagtaaaaaaaatcagaatttctgtagtagaaactacgaaaaataaaaaggaaagtttttactttttgggtatttttttacgaataagaaaaagtgagcgttaatcagttcaaaaggaggtactgctgtgtaatgggctttgtacgttccttctcatgtcacttacgtcactacttcgccatcaaattgaacaagcttttaattagatcctgaaaattcactatgctagtagtttattggtagtattatattttgagtagaactctgattttccctagaggccaaattctttttatctgggttaatttcttttaaacataacaatgttaatgctgaattgtatattaaatcccatttctaaaaaccacacaattttttctcatgtaagttgagtggaatgtggttagttaactgaatttggaatgttcatataaataatttgttgctgctc

SEQ ID NO: 301426 - DNA, 726 bp, Homo sapiens
ttacaaagtttgtgtactatgaattaaaattctttgttttatgtaagcatgtcaatgggaggagaaaaaagtttgatctgttttaaacatactttatttattggcagttctgcatttaacttttgtttaaggctatactgtggctagaattaagctcggagactaccatttctatgggtttggcaccgatgtagattatgaaactgcatttattcattaccgtctggcttctgagcagcaacacagtgcacaagctatgtttaatctgggatatatgcatgagaaaggactgggcattaaacaggatattcaccttgcgaaacgtttttatgacatggcagctgaagccagcccagatgcacaagttccagtcttcctagccctctgcaaattgggcgtcgtctatttcttgcagtacatacgggaaacaaacgtaagtggtccgtacctcttttcattaaaatataaatgatggaaggtctgtcctggaggtttgtttttctctcctcagctcaggtacccgaggaccttatcaggggagggataaatgcaggcataaagcagctactgcagtttttaggtagcgtttgacacttcctgacgctaaagcatttttcatggaggcagatgttttctggtttagggaaaactgagactaactcatggcagtttgaaacagtatttaattcagtaaacattaaatcagatgactcaaaccagtccctt

SEQ ID NO: 301427 - DNA, 6537 bp, Homo sapiens
aagagcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcggatgaagaaggcagccaggatgaatccttagattccaagactactttgacatcagatgagtcagtaaaggaccatactactgcaggcagagtagttgctggtcaaatatttcttgattcagaagaatctgaattagaatcctctattcaagaagaggaagacagcctcaagagccaagagggggaaagtgtcacagaagatatcagctttctagagtctccaaatccagaaaacaaggactatgaagagccaaagaaagtacggaaaccagctttgaccgccattgaaggcacagcacatggggagccctgccacttcccttttcttttcctagataaggagtatgatgaatgtacatcagatgggagggaagatggcagactgtggtgtgctacaacctatgactacaaagcagatgaaaagtggggcttttgtgaaactgaagaagaggctgctaagagacggcagatgcaggaagcagaaatgatgtatcaaactggaatgaaaatccttaatggaagcaataagaaaagccaaaaaagagaagcatatcggtatctccaaaaggcagcaagcatgaaccataccaaagccctggagagagtgtcatatgctcttttatttggtgattacttgccacagaatatccaggcagcgagagagatgtttgagaagctgactgaggaaggctctcccaagggacagactgctcttggctttctgtatgcctctggacttggtgttaattcaagtcaggcaaaggctcttgtatattatacatttggagctcttgggggcaatctaatagcccacatggttttgggttacagatactgggctggcatcggcgtcctccagagttgtgaatctgccctgactcactatcgtcttgttgccaatcatgttgctagtgatatctcgctaacaggaggctcagtagtacagagaatacggctgcctgatgaagtggaaaatccaggaatgaacagtggaatgctagaagaagatttgattcaatattaccagttcctagctgaaaaaggtgatgtacaagcacaggttggtcttggacaactgcacctgcacggagggcgtggagtagaacagaatcatcagagagcatttgactacttcaatttagcagcaaatgctggcaattcacatgccatggcctttttgggaaagatgtattcggaaggaagtgacattgtacctcagagtaatgagacagctctccactactttaagaaagctgctgacatgggcaacccagttggacagagtgggcttggaatggcctacctctatgggagaggagttcaagttaattatgatctagcccttaagtatttccagaaagctgctgaacaaggctgggtggatgggcagctacagcttggttccatgtactataatggcattggagtcaagagagattataaacaggccttgaagtattttaatttagcttctcagggaggccatatcttggctttctataacctagctcagatgcatgccagtggcaccggcgtgatgcgatcatgtcacactgcagtggagttgtttaagaatgtatgtgaacgaggccgttggtctgaaaggcttatgactgcctataacagctataaagatggcgattacaatgctgcagtgatccagtacctcctcctggctgaacagggctatgaagtggcacaaagcaatgcagcctttattcttgatcagagagaagcaagcattgtaggtgagaatgaaacttatcccagagctttgctacattggaacagggccgcctctcaaggctatactgtggctagaattaagctcggagactaccatttctatgggtttggcaccgatgtagattatgaaactgcatttattcattaccgtctggcttctgagcagcaacacagtgcacaagctatgtttaatctgggatatatgcatgagaaaggactgggcattaaacaggatattcaccttgcgaaacgtttttatgacatggcagctgaagccagcccagatgcacaagttccagtcttcctagccctctgcaaattgggcgtcgtctatttcttgcagtacatacgggaaacaaacattcgagatatgttcacccaacttgatatggaccagcttttgggacctgagtgggacctttacctcatgaccatcattgcgctgctgttgggaacagtcatagcttacaggcaaaggcagcaccaagacatgcctgcacccaggcctccagggccacggccagctccaccccagcaggaggggccaccagagcagcagccaccacagtaataggcactgggtccagccttgatcagtgacagcgaaggaagttatctgctgggaacacttgcatttgatttaggaccttggatcagtggtcacctcccagaagaggcacggcacaaggaagcattgaattcctaaagctgcttagaatctgatgcctttattttcagggataagtaactcttacctaaactgagctgaatgtttgtttcagtgccatatggaataacaactttcagtggcttttttttttcttttctggaaacatatgtgagacactcagagtaatgtctactgtatccagctatctttcttggatccttttggtcattatttcagtgtgcataagttcttaatgtcaaccatctttaaggtattgtgcatcgacactaaaaactgatcagtgtaaaaaggaaaacccagttgcaagtttaaacgtgttcgaaagtctgaaaatagaacttgccttttaagttaaaaaaaaaaaaagctatcttgaaaatgttttggaactgcgataactgagaaactcttaccagtccacatgcaattagacatattcagcatatttgttattttaaaagggagggttgggaggtttcttattggtgattgtcacacggtataccatactcctctccttcaaagaatgaaaggccttgttaaggagttttttgtgagctttacttctttggaatggaatatacttatgcaaaaccttgtgaactgactccttgcactaacgcgagtttgccccacctactctgtaatttgcttgtttgttttgaatatacagagccttgatccagaagccagaggatggactaagtgggagaaattagaaaacaaaacgaactctggttggggtactacgatcacagacacagacatacttttcctaaagttgaagcatttgttcccaggatttattttactttgcatttctttttgcacaaagaacacatcaccttcctgaattctttaaatatgaaatatcattgccagggtatggcttacagtgactactattataatactaaaactcagagaatcaaagatggattaaactcagtggttgatgaaagccaaaacctgtttgtactgttctatactattcaggtatctttttatttctgatagttttatattataatagaaagccagccactgcttagctatcatagtcaccattttctcactgttaacattaggaaaatcaaggctactatgcttcaggattgtctggttaaatagtatgggaaaaaaactgaagagtttcacataattacacacgtgaaataattaaagcttaaactgaatttgtatttcattttattgtcagatggtggtgttcaccagcctgtatcttgtctgagactgcattcgtatctgagcaggttttctatgcctactgatgtcagtatgtttatactaaccttcatgcttttttcccagaatccctcatctgccagaaaacttgaaaagtttattgcttgtagagttgtactgctttgatttttgaagttggggtagtagttagaactagatttaactagtctataatgaacatgaaggcttttatatatgaagttgtatacctttttgtgtttagagaattatgggaaacctggtaagcaaaactttcctcccagataattgcttccaaattcgaagagttagtcaccaagagagccatatgtatgaaagcgtatctgtgaaaggtaggaaacttaccccccctaagtgtaatgttgctttaggcaactcttgtaaatagtgagacttgtttggtctcttacatgtagagatttgagtgcagttggtacagtactttggtgtctccaccactgtcccttctccccgcttcaaaataagtgtaatccacggtagcagccacacttccttcagaaggaactgttataatttatttaaaagttgaaaaaccacccaagatgactaccaactttcacttttttcttctgccatccaccctcatttttcctttagcaagatttttatatctaactttccttccctccattgagtacgtgctttgagaaaacatttcttaaaacagtgtgtgccacctaaggctggatgggaaagtgcagtcttgttgttcatataaaaacacacttcttattagtttaccacttgcctttttctattgttaatgttctgaatttccttttcttggcttgtttctacttcattttaccctgggtcacttgctgccagcagtttgtgaatggtgtctttcaaataacttagttcttatggcttcacttaaagactgtctcaaaaatactttgctctcttcttcttttttgttcatgggacatggtacctaagcaaataggagttgggtttggtttttctcctaaaataatgctcaatacttacctaatcaaatggcatccatttgaataaaatgacaataactaaagctagttaatgtcagtgacattaaactaactccaggattcaggagttttaatgttagaatttagatttaacagatagagtgtggcttcatttgtccatggtagcccatctctcctaagaccttttctagtctgtcttcctgccttcgaacttgatgacagtaaaaccctgtttagtattctcttgtgcatttggtttgttggttagccgactgtcttgaaactattcattttgcttctagttttattttacagaggtagcattggtgggtttttttttttttttctgtctctgtgtttgaagtttcagtttctgttttctaggtaaggcttatttttgattagcagtcaatggcaaagaaaaagtaaatcaaagatgacttcttttcaaaatgtattgtttagcacttaactcagatgaatttataaattattaatcttgatactaaggatttgttacttttttgcatattaggttaatttttaccttacatgtgagagtcttaccactaagccattctgtctctgtactgttgggaagttttggaaacccctgccagtgatctggtgatgatctgatgatttatttaaagagccgttgatgcctccaggaaacttaagtattttattaatatatatataggaatttttttttattttgctttgtctttctctcccttcttttatcctcatgttcattcttcaaaccagtgttttggaagtatgcatgcaggcctataaatgaaaaacacaattctttatgtgtatagcatgtgtattaatgtctaactacatacgcaaaaacttcctttacagaggttcggactaacatttcacatgcacatttcaaaacaagatgtgtcatgaaaacagcccctttacctgccaagacaagcagggctatatttcagtgacagctgatatttgttttgaaagtgaatctcataatatatatatgtattacacattattatgactagaagtatgtaagaaatgatcagaacaaaagaaaatttctattttcatgcaaatatttttcatcagtcatcactctcaaatataaattaaaatataacactcctgaatgcctgaggcacgatctggattttaaatgtgtggtattcattgaaaagaagctctccacccacttggtatttcaagaaaatttaaaacgatcccaaggaaagatgatttgtatgttaaagtgactgcacaagtaaaagtccaatgttgtgtgcatgaaaaggattccttggttatgtgcagggaatcatctcacatgctgtttttcctatttggtttgagaaacaggctgacactattctctttgattagaaaataaactcataaaactcataatgttgatataatcaagatgtaaccactataaatatgtagaagaggaagttttaaaagaccttaagctggcattgtgaaggaacaccatggtagactctttttgtaaatgtattttgtatttaatgaaatgcagtataaaggttggtgaagtgtaatataattgtgtaaacaaatcctgttaatagagagatgtacagaatcgttttgtactgtatcttgaaacttgtgaaataaagattccacctctggttatcctgta

SEQ ID NO: 301428 - DNA, 6430 bp, Homo sapiens
aagagcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcggatgaagaaggcagccaggatgaatccttagattccaagactactttgacatcagatgagtcagtaaaggaccatactactgcaggcagagtagttgctggtcaaatatttcttgattcagaagaatctgaattagaatcctctattcaagaagaggaagacagcctcaagagccaagagggggaaagtgtcacagaagatatcagctttctagagtctccaaatccagaaaacaaggactatgaagagccaaagaaagtacggaaaccagctttgaccgccattgaaggcacagcacatggggagccctgccacttcccttttcttttcctagataaggagtatgatgaatgtacatcagatgggagggaagatggcagactgtggtgtgctacaacctatgactacaaagcagatgaaaagtggggcttttgtgaaactgaagaagaggctgctaagagacggcagatgcaggaagcagaaatgatgtatcaaactggaatgaaaatccttaatggaagcaataagaaaagccaaaaaagagaagcatatcggtatctccaaaaggcagcaagcatgaaccataccaaagccctggagagagtgtcatatgctcttttatttggtgattacttgccacagaatatccaggcagcgagagagatgtttgagaagctgactgaggaaggctctcccaagggacagactgctcttggctttctgtatgcctctggacttggtgttaattcaagtcaggcaaaggctcttgtatattatacatttggagctcttgggggcaatctaatagcccacatggttttgggttacagatactgggctggcatcggcgtcctccagagttgtgaatctgccctgactcactatcgtcttgttgccaatcatgttgctagtgatatctcgctaacaggaggctcagtagtacagagaatacggctgcctgatgaagtggaaaatccaggaatgaacagtggaatgctagaagaagatttgattcaatattaccagttcctagctgaaaaaggtgatgtacaagcacaggttggtcttggacaactgcacctgcacggagggcgtggagtagaacagaatcatcagagagcatttgactacttcaatttagcagcaaatgctggcaattcacatgccatggcctttttgggaaagatgtattcggaaggaagtgacattgtacctcagagtaatgagacagctctccactactttaagaaagctgctgacatgggcaacccagttggacagagtgggcttggaatggcctacctctatgggagaggagttcaagttaattatgatctagcccttaagtatttccagaaagctgctgaacaaggctgggtggatgggcagctacagcttggttccatgtactataatggcattggagtcaagagagattataaacaggccttgaagtattttaatttagcttctcagggaggccatatcttggctttctataacctagctcagatgcatgccagtggcaccggcgtgatgcgatcatgtcacactgcagtggagttgtttaagaatgtatgtgaacgaggccgttggtctgaaaggcttatgactgcctataacagctataaagatggcgattacaatgctgcagtgatccagtacctcctcctggctgaacagggctatgaagtggcacaaagcaatgcagcctttattcttgatcagagagaagcaagcattgtaggtgagaatgaaacttatcccagagctttgctacattggaacagggccgcctctcaagcaacacagtgcacaagctatgtttaatctgggatatatgcatgagaaaggactgggcattaaacaggatattcaccttgcgaaacgtttttatgacatggcagctgaagccagcccagatgcacaagttccagtcttcctagccctctgcaaattgggcgtcgtctatttcttgcagtacatacgggaaacaaacattcgagatatgttcacccaacttgatatggaccagcttttgggacctgagtgggacctttacctcatgaccatcattgcgctgctgttgggaacagtcatagcttacaggcaaaggcagcaccaagacatgcctgcacccaggcctccagggccacggccagctccaccccagcaggaggggccaccagagcagcagccaccacagtaataggcactgggtccagccttgatcagtgacagcgaaggaagttatctgctgggaacacttgcatttgatttaggaccttggatcagtggtcacctcccagaagaggcacggcacaaggaagcattgaattcctaaagctgcttagaatctgatgcctttattttcagggataagtaactcttacctaaactgagctgaatgtttgtttcagtgccatatggaataacaactttcagtggcttttttttttcttttctggaaacatatgtgagacactcagagtaatgtctactgtatccagctatctttcttggatccttttggtcattatttcagtgtgcataagttcttaatgtcaaccatctttaaggtattgtgcatcgacactaaaaactgatcagtgtaaaaaggaaaacccagttgcaagtttaaacgtgttcgaaagtctgaaaatagaacttgccttttaagttaaaaaaaaaaaaagctatcttgaaaatgttttggaactgcgataactgagaaactcttaccagtccacatgcaattagacatattcagcatatttgttattttaaaagggagggttgggaggtttcttattggtgattgtcacacggtataccatactcctctccttcaaagaatgaaaggccttgttaaggagttttttgtgagctttacttctttggaatggaatatacttatgcaaaaccttgtgaactgactccttgcactaacgcgagtttgccccacctactctgtaatttgcttgtttgttttgaatatacagagccttgatccagaagccagaggatggactaagtgggagaaattagaaaacaaaacgaactctggttggggtactacgatcacagacacagacatacttttcctaaagttgaagcatttgttcccaggatttattttactttgcatttctttttgcacaaagaacacatcaccttcctgaattctttaaatatgaaatatcattgccagggtatggcttacagtgactactattataatactaaaactcagagaatcaaagatggattaaactcagtggttgatgaaagccaaaacctgtttgtactgttctatactattcaggtatctttttatttctgatagttttatattataatagaaagccagccactgcttagctatcatagtcaccattttctcactgttaacattaggaaaatcaaggctactatgcttcaggattgtctggttaaatagtatgggaaaaaaactgaagagtttcacataattacacacgtgaaataattaaagcttaaactgaatttgtatttcattttattgtcagatggtggtgttcaccagcctgtatcttgtctgagactgcattcgtatctgagcaggttttctatgcctactgatgtcagtatgtttatactaaccttcatgcttttttcccagaatccctcatctgccagaaaacttgaaaagtttattgcttgtagagttgtactgctttgatttttgaagttggggtagtagttagaactagatttaactagtctataatgaacatgaaggcttttatatatgaagttgtatacctttttgtgtttagagaattatgggaaacctggtaagcaaaactttcctcccagataattgcttccaaattcgaagagttagtcaccaagagagccatatgtatgaaagcgtatctgtgaaaggtaggaaacttaccccccctaagtgtaatgttgctttaggcaactcttgtaaatagtgagacttgtttggtctcttacatgtagagatttgagtgcagttggtacagtactttggtgtctccaccactgtcccttctccccgcttcaaaataagtgtaatccacggtagcagccacacttccttcagaaggaactgttataatttatttaaaagttgaaaaaccacccaagatgactaccaactttcacttttttcttctgccatccaccctcatttttcctttagcaagatttttatatctaactttccttccctccattgagtacgtgctttgagaaaacatttcttaaaacagtgtgtgccacctaaggctggatgggaaagtgcagtcttgttgttcatataaaaacacacttcttattagtttaccacttgcctttttctattgttaatgttctgaatttccttttcttggcttgtttctacttcattttaccctgggtcacttgctgccagcagtttgtgaatggtgtctttcaaataacttagttcttatggcttcacttaaagactgtctcaaaaatactttgctctcttcttcttttttgttcatgggacatggtacctaagcaaataggagttgggtttggtttttctcctaaaataatgctcaatacttacctaatcaaatggcatccatttgaataaaatgacaataactaaagctagttaatgtcagtgacattaaactaactccaggattcaggagttttaatgttagaatttagatttaacagatagagtgtggcttcatttgtccatggtagcccatctctcctaagaccttttctagtctgtcttcctgccttcgaacttgatgacagtaaaaccctgtttagtattctcttgtgcatttggtttgttggttagccgactgtcttgaaactattcattttgcttctagttttattttacagaggtagcattggtgggtttttttttttttttctgtctctgtgtttgaagtttcagtttctgttttctaggtaaggcttatttttgattagcagtcaatggcaaagaaaaagtaaatcaaagatgacttcttttcaaaatgtattgtttagcacttaactcagatgaatttataaattattaatcttgatactaaggatttgttacttttttgcatattaggttaatttttaccttacatgtgagagtcttaccactaagccattctgtctctgtactgttgggaagttttggaaacccctgccagtgatctggtgatgatctgatgatttatttaaagagccgttgatgcctccaggaaacttaagtattttattaatatatatataggaatttttttttattttgctttgtctttctctcccttcttttatcctcatgttcattcttcaaaccagtgttttggaagtatgcatgcaggcctataaatgaaaaacacaattctttatgtgtatagcatgtgtattaatgtctaactacatacgcaaaaacttcctttacagaggttcggactaacatttcacatgcacatttcaaaacaagatgtgtcatgaaaacagcccctttacctgccaagacaagcagggctatatttcagtgacagctgatatttgttttgaaagtgaatctcataatatatatatgtattacacattattatgactagaagtatgtaagaaatgatcagaacaaaagaaaatttctattttcatgcaaatatttttcatcagtcatcactctcaaatataaattaaaatataacactcctgaatgcctgaggcacgatctggattttaaatgtgtggtattcattgaaaagaagctctccacccacttggtatttcaagaaaatttaaaacgatcccaaggaaagatgatttgtatgttaaagtgactgcacaagtaaaagtccaatgttgtgtgcatgaaaaggattccttggttatgtgcagggaatcatctcacatgctgtttttcctatttggtttgagaaacaggctgacactattctctttgattagaaaataaactcataaaactcataatgttgatataatcaagatgtaaccactataaatatgtagaagaggaagttttaaaagaccttaagctggcattgtgaaggaacaccatggtagactctttttgtaaatgtattttgtatttaatgaaatgcagtataaaggttggtgaagtgtaatataattgtgtaaacaaatcctgttaatagagagatgtacagaatcgttttgtactgtatcttgaaacttgtgaaataaagattccacctctggttatcctgta

SEQ ID NO: 301429 - DNA, 1369 bp, Homo sapiens
agatgaatttataaattattaatctgagttaagtgctaaacaatacattttgaaaagaagtcatctttgatttactttttctttgccattgactgctaatcaaaaataagccttacctagaaaacagaaactgaaacttcaaaatgtattgtttagcacttaactcagatgaatttataaattattaatcttgatactaaggatttgttacttttttgcatattaggttaatttttaccttacatgtgagagtcttaccactaagccattctgtctctgtactgttgggaagttttggaaacccctgccagtgatctggtgatgatctgatgatttatttaaagagccgttgatgcctccaggaaacttaagtattttattaatatatatataggaatttttttttattttgctttgtctttctctcccttcttttatcctcatgttcattcttcaaaccagtgttttggaagtatgcatgcaggcctataaatgaaaaacacaattctttatgtgtatagcatgtgtattaatgtctaactacatacgcaaaaacttcctttacagaggttcggactaacatttcacatgcacatttcaaaacaagatgtgtcatgaaaacagcccctttacctgccaagacaagcagggctatatttcagtgacagctgatatttgttttgaaagtgaatctcataatatatatatgtattacacattattatgactagaagtatgtaagaaatgatcagaacaaaagaaaatttctattttcatgcaaatatttttcatcagtcatcactctcaaatataaattaaaatataacactcctgaatgcctgaggcacgatctggattttaaatgtgtggtattcattgaaaagaagctctccacccacttggtatttcaagaaaatttaaaacgatcccaaggaaagatgatttgtatgttaaagtgactgcacaagtaaaagtccaatgttgtgtgcatgaaaaggattccttggttatgtgcagggaatcatctcacatgctgtttttcctatttggtttgagaaacaggctgacactattctctttgattagaaaataaactcataaaactcataatgttgatataatcaagatgtaaccactataaatatgtagaagaggaagttttaaaagaccttaagctggcattgtgaaggaacaccatggtagactctttttgtaaatgtattttgtatttaatgaaatgcagtataaaggttggtgaagtgtaatataattgtgtaaacaaatcctgttaatagagagatgtacagaatcgttttgtactgtatcttgaaacttgtgaaataaagattccacctctggttatcctgta

SEQ ID NO: 301430 - DNA, 2615 bp, Homo sapiens
aagagcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcggatgaagaaggcagccaggatgaatccttagattccaagactactttgacatcagatgagtcagtaaaggaccatactactgcaggcagagtagttgctggtcaaatatttcttgattcagaagaatctgaattagaatcctctattcaagaagaggaagacagcctcaagagccaagagggggaaagtgtcacagaagatatcagctttctagagtctccaaatccagaaaacaaggactatgaagagccaaagaaagtacggaaaccagctttgaccgccattgaaggcacagcacatggggagccctgccacttcccttttcttttcctagataaggagtatgatgaatgtacatcagatgggagggaagatggcagactgtggtgtgctacaacctatgactacaaagcagatgaaaagtggggcttttgtgaaactgaagaagaggctgctaagagacggcagatgcaggaagcagaaatgatgtatcaaactggaatgaaaatccttaatggaagcaataagaaaagccaaaaaagagaagcatatcggtatctccaaaaggcagcaagcatgaaccataccaaagccctggagagagtgtcatatgctcttttatttggtgattacttgccacagaatatccaggcagcgagagagatgtttgagaagctgactgaggaaggctctcccaagggacagactgctcttggctttctgtatgcctctggacttggtgttaattcaagtcaggcaaaggctcttgtatattatacatttggagctcttgggggcaatctaatagcccacatggttttgggttacagatactgggctggcatcggcgtcctccagagttgtgaatctgccctgactcactatcgtcttgttgccaatcatgttgctagtgatatctcgctaacaggaggctcagtagtacagagaatacggctgcctgatgaagtggaaaatccaggaatgaacagtggaatgctagaagaagatttgattcaatattaccagttcctagctgaaaaaggtgatgtacaagcacaggttggtcttggacaactgcacctgcacggagggcgtggagtagaacagaatcatcagagagcatttgactacttcaatttagcagcaaatgctggcaattcacatgccatggcctttttgggaaagatgtattcggaaggaagtgacattgtacctcagagtaatgagacagctctccactactttaagaaagctgctgacatgggcaacccagttggacagagtgggcttggaatggcctacctctatgggagaggagttcaagttaattatgatctagcccttaagtatttccagaaagctgctgaacaaggctgggtggatgggcagctacagcttggttccatgtactataatggcattggagtcaagagagattataaacaggccttgaagtattttaatttagcttctcagggaggccatatcttggctttctataacctagctcagatgcatgccagtggcaccggcgtgatgcgatcatgtcacactgcagtggagttgtttaagaatgtatgtgaacgaggccgttggtctgaaaggcttatgactgcctataacagctataaagatggcgattacaatgctgcagtgatccagtacctcctcctggctgaacagggctatgaagtggcacaaagcaatgcagcctttattcttgatcagagagaagcaagcattgtaggtgagaatgaaacttatcccagagctttgctacattggaacagggccgcctctcaaggctatactgtggctagaattaagctcggagactaccatttctatgggtttggcaccgatgtagattatgaaactgcatttattcattaccgtctggcttctgagcagcaacacagtgcacaagctatgtttaatctgggatatatgcatgagaaaggactgggcattaaacaggatattcaccttgcgaaacgtttttatgacatggcagctgaagccagcccagatgcacaagttccagtcttcctagccctctgcaaattgggcgtcgtctatttcttgcagtacatacgggaaacaaacgtaagtggtccgtacctcttttcattaaaatataaatgatggaaggtctgtcctggaggtttgtttttcaaaagttgagaagcacagggaagagtggtcctgcaggtatcgggtgtgttcccttctcctcagctcaggtacccgaggaccttatcaggggagggataaatgcaggcataaagcagctactgcagtttttaggtagcgtttgacacttcctgacgctaaagcatttttcatggaggcagatgttttctggtttagggaaaactgagactaactcatggcagtttgaaacagtatttaattcagtaaacattaaatcagatgactcaaaccagtccctt

SEQ ID NO: 301431 - DNA, 391 bp, Homo sapiens
aaatgcacacacttcaaaaataaagtttatgacatctattttgattgctctaggaactatattatttatttccttgctcttagctatggccttcttgttgaagttgctgaatccattacctcaaaacctaacacttagcataaataaggtgttagtgtacttggatcaaatgacagcaaaattctgggtatgcttagctttatttgttccacgaagaatgacactgaagtacatgaaactgctgcctcctcacgtgaagttgttttacagggttacagatactgggctggcatcggcgtcctccagagttgtgaatctgccctgactcactatcgtcttgttgccaatcatggtatctatgtttccccttttaccttttaggaaaaaaaaa

SEQ ID NO: 301432 - DNA, 431 bp, Homo sapiens
cgtgatgcgatcatgtcacactgcagtggaggtaaggtctttcctaccagcttgtgtgtagggagttgatttgcccagcaggaaagtctgcgctttcaattctggtttttttgtatgttttcttctgtagttcctagactcagcctacctagctttgatatactgagggaagaccgaggggtctgtgtgtaattaccatacttatttattcagtgtctccctattacaatcaactgtataaggggagatactggtgtctgcagtatctctagcacctaagacagtatctgataataatcagcatcaaaaaaatatataagctgagcacaatggcacgtgcctatagtcccagctacttaggaggttgaggtggatgaaggcttgagcccaggagtttgagaccaacctggacaacatagaaagaacctatc

SEQ ID NO: 301433 - DNA, 512 bp, Homo sapiens
caagaaatgcatttttgtttcttacctgtattataggatattcaccttgcgaaacgtttttatgacatggcagctgaagccagcccagatgcacaagttccagtcttcctagccctctgcaaattgggcgtcgtctatttcttgcagtacatacgggaaacaaacgtaagtggtccgtacctcttttcattaaaatataaatgatggaaggtctgtcctggaggtttgtttttcaaaagttgagaagcacagggaagagtggtcctgcaggtatcgggtgtgttcccttctcctcagctcaggtacccgaggaccttatcaggggagggataaatgcaggcataaagcagctactgcagtttttaggtagcgtttgacacttcctgacgctaaagcatttttcatggaggcagatgttttctggtttagggaaaactgagactaactcatggcagtttgaaacagtatttaattcagtaaacattaaatcagatgactcaaaccagtccctt

SEQ ID NO: 301434 - DNA, 414 bp, Homo sapiens
agcttgtattagattcacatatttactcagtaagaattctttcattagagttttattcttcatatataagccttctctgatacttagctaaatcttaagtctattatctcgtgtgatttttttttttcttacagatggcattggagtcaagagagattataaacaggccttgaagtattttaatttagcttctcagggaggccatatcttggctttctataacctagctcagatgcatgccagtggcaccggcgtgatgcgatcatgtcacactgcagtggaggtaaggtctttcctaccagcttgtgtgtagggagttgatttgcccagcaggaaagtctgcgctttcaattctggtttttttgtatgttttcttctgtagttcctagactcagcctacctagctttgatata

SEQ ID NO: 301435 - DNA, 628 bp, Homo sapiens
ctttctgagagcagcatacaaattgtttcacaaaaactctatttacttttcttcaccaccttaaatattaatccccctatgacttaatgtatattattatctattataagaattagaaagtggtctttttaatggctctttgggaatatttttttatatgctttgttcatttttttaaataaatctcttaacttttgagtatgtctgccttttgagctttctcatcatatgacatctttttctacagaattatgatctagcccttaagtatttccagaaagctgctgaacaaggctgggtggatgggcagctacagcttggttccatgtactatagtaagtaacactggaattaatgatggatacaccaagatctaaattaagctgttttctactagatggcattatgatgtggaaatgggtgctatcaaattctggctggttaaatgttctcccagttcaatgatttgtacatcttgtttttcattgtaaattatattaatctgtatcagtgtgttagcttgtattagattcacatatttactcagtaagaattctttcattagagttttattcttcatatataagccttctctgatacttagctaaatcttaagtctattatctcg

SEQ ID NO: 301436 - DNA, 1316 bp, Homo sapiens
cgcgcggccggttactcgcttaccggaggcttcagtccccggcggcgcggcgacagctagggttcacggccactggggcagaggagccgcgagaagatgtgggtttttggttacgggtccctgatctggaaggtggatttcccctatcaggacaagctggtcggatacatcaccaactacagcaggcgcttctggcagggcagcacggaccaccgcggggtccccggcaagcctggaagagttgtgactcttgttgaagatcctgcgggatgtgtatggggtgttgcttacagattgccagtaggaaaggaagaagaagtaaaagcataccttgacttcagagaaaaaggaggctacagaaccacaacagtcattttttatccaaaagatcccacaacaaaaccattcagtgtattgctatatattggaacatgtgataatcctgattatcttggtcctgcacctctggaagacattgctgaacaaatttttaatgcagctggtccaagtggaagaaatacagaatatctttttgaacttgcaaattctattaggaaccttgtgccagaagaagcagatgagcatcttttcgctttggaaaaattagtaaaggaacgtttagaagggaaacagaacctcaattgcatataatttagtcttcagagaattaacttcagtgcacaatgacaatatgatttggaaatacgtttacttaaagatcttatttttaatgtagtgaggatattatttaaacttttattttaactggaaatgtcctgaaacacatatttaaaatattgggatacagtgaaagaaaaattcaaattttaataacataaagatttcctaactttatgttattgaacacttactcactagaagtgagttctttagaaaaatacagtgaaggactcagttcagtcttgtttttatcagagtgataatcatcctgtttcacatcccaatactattttgaaattctaaacaattaaaccaaaattccaataaatataaggttatgccttcaatatattcctatacaattctgtaaccatggtttaaaatacacaagcttaaaataacatgcttagaaatacacaataatatgaacagtatttcagccttaattgtgaatttccttgttattcaagtattaaatgaaatcttttgagtttttagccaaaaattggcatttttaaaatacgaaaatttccttggaattataatgtactgtacctcttcttttttaaataaaggcattttactatatggaaaataactcactaaagcataaattacattatacaaatcatgat

SEQ ID NO: 301437 - DNA, 1269 bp, Homo sapiens
cgcgcggccggttactcgcttaccggaggcttcagtccccggcggcgcggcgacagctagggttcacggccactggggcagaggagccgcgagaagatgtgggtttttggttacgggtccctgatctggaaggtggatttcccctatcaggacaagctggtcggatacatcaccaactacagcaggcgcttctggcagggcagcacggaccaccgcggggtccccggcaagcctggaagagttgtgactcttgttgaagatcctgcgggatgtgtatggggtgttgcttacagattgccagtaggaaaggaagaagaagtaaaagcataccttgacttcagagaaaaaggaggctacagaaccacaacagtcattttttatccaaaagatcccacaacaaaaccattcagtgtattgctatatattggaacatgtgataatcctgattatcttggtcctgcacctctggaagacattgctgaacaaatttttaatgcagctggtccaagtggaagaaatacagaatatctttttgaacttgcaaattctattaggaaccttgtgccagaagaagcagatgagcatcttttcgctttggaaaaattagtaaaggaacgtttagaagggaaacagaacctcaattgcatataatttagtcttcagagaattaacttcagtgcacaatgacaatatgatttggaaatacgtttacttaaagatcttatttttaatgtagtgaggatattatttaaacttttattttaactggaaatgtcctgaaacacatatttaaaatattgggatacagtgaaagaaaaattcaaattttaataacataaagatttcctaactttatgttattgaacacttactcactagaagtgagttctttagaaaaatacagtgaaggactcagttcagtcttgtttttatcagagtgataatcatcctgtttcacatcccaatactattttgaaattctaaacaattaaaccaaaattccaataaatataaggttatgccttcaatatattcctatacaattctgtaaccatggtttaaaatacacaagcttaaaataacatgcttagaaatacacaataatatgaacagtatttcagccttaattgtgaatttccttgttattcaagtattaaatgaaatcttttgagtttttagccaaaaattggcatttttaaaatacgaaaatttccttggaattataatgtactgtacctcttcttttttaaataaaggcattttactata

SEQ ID NO: 301438 - DNA, 1343 bp, Homo sapiens
cgcgcggccggttactcgcttaccggaggcttcagtccccggcggcgcggcgacagctagggttcacggccactggggcagaggagccgcgagaagatgtgggtttttggttacgggtccctgatctggaaggtggatttcccctatcaggacaagctggtcggatacatcaccaactacagcaggcgcttctggcagggcagcacggaccaccgcggggtccccggcaagcctggaagagttgtgactcttgttgaagatcctgcgggatgtgtatggggtgttgcttacagattgccagtaggaaaggaagaagaagtaaaagcataccttgacttcagagaaaaaggaggctacagaaccacaacagtcattttttatccaaaagatcccacaacaaaaccattcagtgtattgctatatattggaacatgtgataatcctgattatcttggtcctgcacctctggaagacattgctgaacaaatttttaatgcagctggtccaagtggaagaaatacagaatatctttttgaacttgcaaattctattaggaaccttgtgccagaagaagcagatgagcatcttttcgctttggaaaaattagtaaaggaacgtttagaagggaaacagaacctcaattgcatataatttagtcttcagagaattaacaagaaggctttgttggccgaaaggtttttcagtgcacaatgacaatatgatttggaaatacgtttacttaaagatcttatttttaatgtagtgaggatattatttaaacttttattttaactggaaatgtcctgaaacacatatttaaaatattgggatacagtgaaagaaaaattcaaattttaataacataaagatttcctaactttatgttattgaacacttactcactagaagtgagttctttagaaaaatacagtgaaggactcagttcagtcttgtttttatcagagtgataatcatcctgtttcacatcccaatactattttgaaattctaaacaattaaaccaaaattccaataaatataaggttatgccttcaatatattcctatacaattctgtaaccatggtttaaaatacacaagcttaaaataacatgcttagaaatacacaataatatgaacagtatttcagccttaattgtgaatttccttgttattcaagtattaaatgaaatcttttgagtttttagccaaaaattggcatttttaaaatacgaaaatttccttggaattataatgtactgtacctcttcttttttaaataaaggcattttactatatggaaaataactcactaaagcataaattacattatacaaatcatgat

SEQ ID NO: 301439 - DNA, 2492 bp, Homo sapiens
acccctgtcatgcgcattgagagtcctctagacaggcgctcctcgcagcaccgtagtgcgcttgcgctgagcagcccgcgagggcggaagtgggagctgcgaccgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcattgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacgtgccataactactttattgaagaccttggattgccagtgtggggatcatatactgtttttgctttagcaactctgttttccggactgttattaggactctgtatgatatttgtggcagattgcctttgtccttcaaaaaggcgcagaccacagccatacccatacccttcaaaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctagaatacatagttttcaccttaaaagaagggggaaaatcataaatacaatgaatcaactgaccattacgtagtagacaatttctgtaatgtccccttctttctaggctctgttgctgtgtgaatccattagatttacagtatcgtaatatacaagttttctttaaagccctctcctttagaatttaaaatattgtaccattgaagagtttggatgtgtaacttgtgatgccttagaaaaatatcctaagcacaaaataaacctttctaaccacttca

SEQ ID NO: 301440 - DNA, 834 bp, Homo sapiens
acccctgtcatgcgcattgagagtcctctagacaggcgctcctcgcagcaccgtagtgcgcttgcgctgagcagcccgcgagggcggaagtgggagctgcgaccgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcagtaagtatttgaagactctaaattatggagaaggatgcattatagtgtaatcagaagtagtaggcctctggcttggatcatgctggaagagctgaggtaatctcattatattcagcaggtattttagagggcttgttttgcttagtgttatcctaggtgcctttaggtagttgagtgatgtgtgaaacagtctctgttctcaaagatttacagttgttttggaaagtgatgttcttgtgaaatggtgtgatcctgttcagcgtgttaagtcattatgcatccaaagtagtggtgagtcctgtaggtaattggataaaggagaaatcacagttacctggattggttcccagagaatatggggtttaaatgaaaccttggaagtagaa

SEQ ID NO: 301441 - DNA, 2883 bp, Homo sapiens
acccctgtcatgcgcattgagagtcctctagacaggcgctcctcgcagcaccgtagtgcgcttgcgctgagcagcccgcgagggcggaagtgggagctgcgaccgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcattgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacgtgccataactactttattgaagaccttggattgccagtgtggggatcatatactgtttttgctttagcaactctgttttccggactgttattaggactctgtatgatatttgtggcagattgcctttgtccttcaaaaaggcgcagaccacagccatacccatacccttcaaaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctagaatacatagttttcaccttaaaagaagggggaaaatcataaatacaatgaatcaactgaccattacgtagtagacaatttctgtaatgtccccttctttctaggctctgttgctgtgtgaatccattagatttacagtatcgtaatatacaagttttctttaaagccctctcctttagaatttaaaatattgtaccattgaagagtttggatgtgtaacttgtgatgccttagaaaaatatcctaagcacaaaataaacctttctaaccacttcattaaagctgaagaccagtatgatttctggttgctttttgaaggtatgctttattactttgtatttaacgatgttcagatgagtagttgtgtgttcctatatatgtacttgatatgtgtaatcaaaagactgccttctttttctattgagatgtttaaggacagtaatgctcattaatcaagcattttttttttttagtgttctagtatatgtgacatggccaatttttttattagaaaatatgtgaccagaaagattctatagagtaaaaaatcaaagcaaaacaaaaaccacaaaaagacccctgtactatagaaaatgtaaagttggctgaacagatagggtcttgaaatttcaggaaacatataatctcacggttcttaaagattgtc

SEQ ID NO: 301442 - DNA, 2510 bp, Homo sapiens
acccctgtcatgcgcattgagagtcctctagacaggcgctcctcgcagcaccgtagtgcgcttgcgctgagcagcccgcgagggcggaagtgggagctgcgaccgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcattgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacgtgccataactactttattgaagaccttggattgccagtgtggggatcatatactgtttttgctttagcaactctgttttccggactgttattaggactctgtatgatatttgtggcagattgcctttgtccttcaaaaaggcgcagaccacagccatacccatacccttcaaaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactcccctaccctctcccccccaatcctctcctgtaacttaagagcagtgggtatataggcaagggatccaaatctcattaatgtagtagtctacccccgttacccccctgtatgaatggccatacaggctgagttgaatcatgacaaagttgaaagggccaatacagccccttttataaggattctgaatgttttgcaaatgtattggtccctgtgttgtattttgtagccttttcctgggcttcagctcccctacttcttgtatgtgtatgcatcctgtagctaccctttatagtcatggcacacaaa

SEQ ID NO: 301443 - DNA, 2795 bp, Homo sapiens
tcatcgctgtctggaacagcgatgactcgagagcggaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcattgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacgtgccataactactttattgaagaccttggattgccagtgtggggatcatatactgtttttgctttagcaactctgttttccggactgttattaggactctgtatgatatttgtggcagattgcctttgtccttcaaaaaggcgcagaccacagccatacccatacccttcaaaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctagaatacatagttttcaccttaaaagaagggggaaaatcataaatacaatgaatcaactgaccattacgtagtagacaatttctgtaatgtccccttctttctaggctctgttgctgtgtgaatccattagatttacagtatcgtaatatacaagttttctttaaagccctctcctttagaatttaaaatattgtaccattgaagagtttggatgtgtaacttgtgatgccttagaaaaatatcctaagcacaaaataaacctttctaaccacttcattaaagctgaagaccagtatgatttctggttgctttttgaaggtatgctttattactttgtatttaacgatgttcagatgagtagttgtgtgttcctatatatgtacttgatatgtgtaatcaaaagactgccttctttttctattgagatgtttaaggacagtaatgctcattaatcaagcattttttttttttagtgttctagtatatgtgacatggccaatttttttattagaaaatatgtgaccagaaagattctatagagtaaaaaatcaaagcaaaacaaaaaccacaaaaagacccctgtactatagaaaatgtaaagttggctgaacagatagggtcttgaaatttcaggaaacatataatctcacggttcttaaagattgtc

SEQ ID NO: 301444 - DNA, 2829 bp, Homo sapiens
acccctgtcatgcgcattgagagtcctctagacaggcgctcctcgcagcaccgtagtgcgcttgcgctgagcagcccgcgagggcggaagtgggagctgcgaccgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcattgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacgtgccataactactttattgaagaccttggattgccagtgtggggatcatatactgtttttgctttagcaactctgttttccggactgttattaggactctgtatgatatttgtggcagattgcctttgtccttcaaaaaggcgcagaccacagccatacccatacccttcaaaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataatattgcagggttcagtctagattgtcattaaattgaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctagaatacatagttttcaccttaaaagaagggggaaaatcataaatacaatgaatcaactgaccattacgtagtagacaatttctgtaatgtccccttctttctaggctctgttgctgtgtgaatccattagatttacagtatcgtaatatacaagttttctttaaagccctctcctttagaatttaaaatattgtaccattgaagagtttggatgtgtaacttgtgatgccttagaaaaatatcctaagcacaaaataaacctttctaaccacttcattaaagctgaagaccagtatgatttctggttgctttttgaaggtatgctttattactttgtatttaacgatgttcagatgagtagttgtgtgttcctatatatgtacttgatatgtgtaatcaaaagactgccttctttttctattgagatgtttaaggacagtaatgctcattaatcaagcattttttttttttagtgttctagtatatgtgacatggccaatttttttattagaaaatatgtgaccagaaagattctatagagtaaaaaatcaaagcaaaacaaaaaccacaaaaagacccctgtactatagaaaatgtaaagttggctgaacagatagggtcttgaaatttcaggaaacatataatctcacggttcttaaagattgtc

SEQ ID NO: 301445 - DNA, 775 bp, Homo sapiens
acccctgtcatgcgcattgagagtcctctagacaggcgctcctcgcagcaccgtagtgcgcttgcgctgagcagcccgcgagggcggaagtgggagctgcgaccgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcattgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacgtgccataactactttattgaagaccttggattgccagtgtggggatcatatactgtttttaattaatgtaaggtagtttttattagttgcataacctaaaaatacaaggaaatttcgatataccctctaaaaagaccacgaaagtgtca

SEQ ID NO: 301446 - DNA, 3190 bp, Homo sapiens
catcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattac

SEQ ID NO: 301447 - DNA, 1069 bp, Homo sapiens
catcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaaagtcaa

SEQ ID NO: 301448 - DNA, 717 bp, Homo sapiens
catcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccggggtaagggccgcgcgaggaggccttggcggccacagacgccggcggggacgagcagctggcgcacgggccctcggcccccagggct

SEQ ID NO: 301449 - DNA, 819 bp, Homo sapiens
catcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaaggagacagaggttgcagtgagccgagatcgtgccattgcactccagcctgggcgacaagagaaactctgtctcaatc

SEQ ID NO: 301450 - DNA, 655 bp, Homo sapiens
taaaagactgactgttcataaactgctacccagtagacaaaattaattgacaccaagtaatactttccagatttcacttaaatcagctataccagaaattgtaaaatcttactcacagaacctcctatgaacccaaccaaaaacagagagaagattgtagaggtgagtttttatgcaggatatgcatatgtgtatttctgtgatattatgttaaatcaaaaattttcttactgttgctatggataaagagaataaaaataattgttttccttcagatcttattaagtatctactatatgctagtcattattctaagtaggaaagtaggatagatcagtaaacaaaaaatcctactgccatggagtgtatatattctaacagggaaaaacagaccaaaaaaattaagtttttaatttagtgagttaattaagttaattaagtttttatggaggagccagcagaaggagactgaaaaggctaatacaataagcagttacagagttaattaaatggtttgttagaaggtgagtgatccagttgacccatgagcaatgcaggggttaggggcaccaaccctccctactcacgtgcaaacttaactaccacccaaaatacttaacttctaatagcctactgttgaccagaagccttactg

SEQ ID NO: 301451 - DNA, 4288 bp, Homo sapiens
catcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatggctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccatgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaaagtcaa

SEQ ID NO: 301452 - DNA, 3932 bp, Homo sapiens
ttccgggtgggggcggcgggcgagaccggcactggacatggagcctactgaccgcccggcagggacctgctccgcgctaatgcgggggcaattgggctaaagcggacggaagcgtaaaaggctcggtttgtgtgttccgagaagggctcttttccccagggccaccggtttgtaaaaaggagaaagacctagaggccttcctcttcctgtatagttgaagatacaccaaacgagaagcaggaagcgggtttacttaaaaaaaaaaaaaaaaaaaggtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatggctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccatgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaaagtcaa

SEQ ID NO: 301453 - DNA, 4192 bp, Homo sapiens
atttgcctatatcttaattttttataactctacaaattctcattcaccttggtgaggcatatgtagaaacagtttaaattcttattcaggcatatgtagatagaagtttgtgctatttataagttagttggtgtatgtatgcattattatagagtaataaagaatcattttattttttgcttctttcattatgctttatagtacttacatttatcattttgatatttagtgcaaagaaatgtgctgcatgcattgagcatttttctacaagtttttttccccctgatgtgctatttcacatatcacaggccttattttttgaacaattgagcaaaagaaacagatgaaacctcatacaaaaccctccaaaatatgaaaatgtggggtttatttgtgctaatgctcttcttttggaaacatttgtgttaaaggtaaggtcaatttattgatttaaaccacattgtatgtaaaaatgtattatccatgattaaactttctaagacattgttcttgatagaaaagattttctaacttgtggaataaaaagatttattttgcaagtgtcagaaatattaaaattaattattcccaagttttcttaaatattatgcaaaactttgatctacagctttgacataattttctaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatggctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccatgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaaagtcaa

SEQ ID NO: 301454 - DNA, 4565 bp, Homo sapiens
  misc_feature (4306)..(4306): n is a, c, g, or t
  misc_feature (4308)..(4308): n is a, c, g, or t
catcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatggctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccatgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaaagtcaaacaaccaaaccacaacananacaaaaaacattgttggcgggcgcctccgggccgtaaagagaggtctcaaaaaccatcccggtgggccgccggcgccccagatatgtgacgtgacgcacctcggcgcaaaacgcgtggtcccaagagagaaccctgcggcatcaccacaggctgcgtggttcccccacaaataaaaaaaacccgcggggggacacccgcgcgtctggacaacactcccgatggggtccagggcgcacagcggatctacaacaccggg

SEQ ID NO: 301455 - DNA, 4234 bp, Homo sapiens
catcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatggctttgaaagaagaggcttaatttgggggtggtaactaaaatcaaataagcagcagaaggttagttttaattatgtagcttctgttaatattaagtgttttttgtctgttttacctcaatttgaacagataagtttgcctgcatgctggacatgcctcagaaccatgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaaagtcaa

SEQ ID NO: 301456 - DNA, 4308 bp, Homo sapiens
catcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatggctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccatgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaaagtcaaaaaaacacaccacaacaaga

SEQ ID NO: 301457 - DNA, 4551 bp, Homo sapiens
catcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatggctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccatgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaaagtcaacataacaagagcaacaacacaaaaaaaaaaaaaaattggttgcgcggctcgcgcgccccgaaaaaaagtttcaaaccatgtctgggggccgcgggcgccagaggggaggaacattggcccaaagcgttccaaggaaaccctggccagagaacgggggggttttcccccaaataaaaaccgcgggggaccgcgtttgcgacacatccaggggtccgcggctcacggctcacacagggccaggacgtagcccccgcgggggggag

SEQ ID NO: 301458 - DNA, 4231 bp, Homo sapiens
catcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatggctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccatgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaattaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaaagtcaa

SEQ ID NO: 301459 - DNA, 2105 bp, Homo sapiens
tccccccggtggccgccgcttctagaataattggattccccggggttgcaggaattcggcacatgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatggctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccatgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaaagtcaa

SEQ ID NO: 301460 - DNA, 2009 bp, Homo sapiens
ttaggctggtgttagggttcttgttttggggttggcagagatgtgtttaagtgctgtggccagaagggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatggctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccatgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaattctgttttaaaaagcaatctgattcttagctcttgaaactattgctacttaaatttccaataattaaaaatttaaaatttttaaattagaattgccaatacttctacatttgagaagggtttttttagaaatacatttagtaaagtccccaagacattagtcttacatttaaacttttttctttaaaacatggttttggtggttaacttttacacagttctgagtactgttaatatctggaaagtatcttgagatatcagtggaaagctaaacagtctaaattaacatgaaatacttcattttgattgagaaaataaaatcagattttttcaaaagtcaa

SEQ ID NO: 301461 - DNA, 3986 bp, Homo sapiens
catcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatggctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccatgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaaaatggtgcattatgtatatatattataatttagaaataccattttataattttactattccagggtgacataatgcatttaaatttgggatttgggtggagtattacgcctaacctggcaccgccaagtttctagcacccctcgaacaaatcttaacgtccagagcgaacaatctacactcttcgacgtgact

SEQ ID NO: 301462 - DNA, 3876 bp, Homo sapiens
  misc_feature (3795)..(3795): n is a, c, g, or t
  misc_feature (3799)..(3799): n is a, c, g, or t
  misc_feature (3812)..(3813): n is a, c, g, or t
  misc_feature (3815)..(3816): n is a, c, g, or t
  misc_feature (3823)..(3823): n is a, c, g, or t
  misc_feature (3832)..(3832): n is a, c, g, or t
catcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatggctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccatgaatagcccgtactagatcttgggaacatggatcttagagtcactttggaataagttcttatataaatacccccagccttttgagaacggggcttgttaaaggacgcgtatgtagggcccgtacctactggcagttgggttcagggaaatgggattgacttggccttcaggctcctttggtcataattttaaaatatgggagtagaaaacaacaaagaatggaatggactcttaaaacaatgaaagagcatttatcgtttgtcccttgaatgtagaatttgtttttgatttcataattctgctggtaaatgtgacagttaacngggnctttgtttttttnntnntcgaaanccctttaanttcaatcccgggagaaaagagccaaaaggggggcggggaaaaga

SEQ ID NO: 301463 - DNA, 3511 bp, Homo sapiens
  misc_feature (3489)..(3489): n is a, c, g, or t
catcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagtctttggtattttgtaaacgttagcagactttcctgccagtgtcagaaaatcctatttatgaatcctgtcggtattccttggtatctgaaaaaaataccaaatagtaccatacatgagttatttctaagtttgaaaaataaaaagaaattgcatcacactaattacaaaatacaagttctggaaaaaatatttttcttcattttaaaacttttttttaactaataatggctttgaaagaagaggcttaatttgggggtggtaactaaaatcaaaagaaatgattgacttgagggtctctgtttggtaagaatacatcattagcttaaataagcagcagaaggttagttttaattatgtagcttctgttaatattaagtgttttttgtctgttttacctcaatttgaacagataagtttgcctgcatgctggacatgcctcagaaccatgaatagcatgcaggcanacttatctgttcaaattgaggt

SEQ ID NO: 301464 - DNA, 3149 bp, Homo sapiens
catcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgttgttttgatttgaaacctggaaatacagtaaaatttgactgtttaaaatgttggccaaaaaaatcaagatttaatttttttatttgtactgaaaaactaatcataactgttaattctcagccatctttgaagcttgaaagaagagccccaccccagggactccccttcccttgggccccttccccttttttatgaggaaataaaatgccgtaactttttggaaccccagttttttgattttttatttgggtaggtttggggtccaggcca

SEQ ID NO: 301465 - DNA, 3103 bp, Homo sapiens
catcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaattattcttttatataactgaccagtgcttaataaaacaagcaggtacttacaaataattactggcagtaggttataattggtggtttaaaaataacattggaatacaggacttgttgccaattgggtaattttcattagttgttttgttgttttgatttgaaacctggaaatacagtaaaatttgactgtttaaaatgttggccaaaaaaatcaagatttaatttttttatttgtactgaaaaactaatcataactgttaattctcagataccaaggaataccgacaggattcataaataggattttctgacactggcaggaaagtctgctaacgtttacaaaataccaaagactcttctttcaagctttaa

SEQ ID NO: 301466 - DNA, 2872 bp, Homo sapiens
catcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttggggaagctttgttaaatttttgttaatgtgggtaaatctgagtttaattcaactgcttccctacatagactagagggctaaggattctgtctgctgctttgtttcttctaagtaggcatttagatcattcctgtaggcttcctattttcactttactgctctaatgctgctagtcgtagtctttagcacactaggtggtatgcctttattagcataaaacaaaaaaaactttaacaggagcttttacatattactgggatggggggtggttcgggatgggtgggcagctgctgaaccctttagggcatttcctctgtaatgtggcgctttcaactgtactgctgcagctttaagtaccttaaagcttctcctgtgaacttcttagggaaatgttaggttcagaactaaagtgttttgggtgggttttgttgcgggggggagggtaacaatgggtggtcttctgatttttatttttgaggttttgtcaactggagtacgtagaggaactttatttacagtactttgatttggcaggttttcttctacttgtgctctgcctggagctgtttccatatgatataaaaagcaagtgtagtattccattactatgtggcttagggatttatttgttttttaaaatcaaccatgttagctgggattagactccctacagtccttcaatggaaaagtaacatttaaaaatcctttgggtaattcaaattacagatttaaaagagcttaagatctggtgttttgttaatgcttctgtttattccagaagcattaaggtaacccattgccaagtatcattcttgcaaacccttctccccccgcgagggggggcgggaaaaagcgagggtcgggggcgccgccccccccccccccccccccccccccccctcaggggggggccccggtaccccaatttccccttataggaagtcgttttaacatttacct

SEQ ID NO: 301467 - DNA, 1941 bp, Homo sapiens
catcccagttctgtccgctgaaaaggcctagaagcaataacacaccaagccctgtcgaatggtggggtccgccaggacctccaggcttgctccccgccctacccgccagcttctccgccacattccactgccgcagcagaaccggtgtccttcacctgcctgcgtcttctgcagttcgttaagcagcgcccttagctcctgtgacactttagggagaaagccgcagcaccggcgatgttggccgccattaacgcccggcaaagcgcccggaactagaagcagcgaagaacccgggtgggcagcgaccgtgacagccgagccggaagcggagctgcgggaggggcctcgacgctcctccatcttttattggagctcaccgctgccagtcgcgctgcctgcccgtcccacccttttcgtgcaggcattcagctaaatgacgggcggagcccggcggcggcttccggtcgggggaaaaaagttgggccgaaggaggggccgggaagacgcaagaggaagaagagaaaacggccgggcggcggtggctgtaggttgtgcggctgcagcggctcttccctgggcggacgatggacagccagggcaggaaggtggtggtgtgcgacaacggcaccgggtttgtgaagtgtggatatgcaggctctaactttccagaacacatcttcccagctttggttggaagacctattatcagatcaaccaccaaagtgggaaacattgaaatcaaggatcttatggttggtgatgaggcaagtgaattacgatcaatgttagaagttaactaccctatggaaaatggcatagtacgaaattgggatgacatgaaacacctgtgggactacacatttggaccagagaaacttaatatagataccagaaattgtaaaatcttactcacagaacctcctatgaacccaaccaaaaacagagagaagattgtagaggtaatgtttgaaacttaccagttttccggtgtatatgtagccatccaggcagttctgactttgtacgctcaaggtttattgactggtgtagtggtagactctggagatggtgtgactcacatttgcccagtatatgaaggcttttctctccctcatcttaccaggagactggatattgctgggagggatataactagatatcttatcaagctacttctgttgcgaggatacgccttcaaccactctgctgattttgaaacggttcgcatgattaaagaaaaactgtgttacgtgggatataatattgagcaagagcagaaactggccttagaaaccacagtattagttgaatcttatacactcccagatggacgtatcatcaaagttgggggagagagatttgaagcaccagaagctttatttcagcctcacttgatcaatgttgaaggagttggtgttgctgaattgctttttaacacaattcaggcagctgacattgataccagatctgaattctacaaacacattgtgctttctggagggtctactatgtatcctggcctgccatcacggttggaacgagaacttaaacagctttacttagaacgagttttgaagggtgatgtggaaaaactttctaaatttaagatccgcattgaagacccaccccgcagaaagcacatggtattcctgggtggtgcagttctagcggatatcatgaaagacaaagacaacttttggatgacccgacaagagtaccaagaaaagggtgtccgtgtgctagagaaacttggtgtgactgttcgataaactccaaagcttgttcccatcatacccgtaatgctttcttttttcctttattgccaatctttgaactcattcaactccaggacatggaagaggcctctctctgccctttgactggaaaggtcaagttttattctggtgtcttgttgggagcttaggatcctctagagcaacc

SEQ ID NO: 301468 - DNA, 362 bp, Homo sapiens
aaagcggacggaagcgtaaaaggctcggtttgtgtgttccgagaagggctcttttccccagggccaccggtttgtaaaaaggagaaagacctagaggccttcctcttcctgtatagttgaagatacaccaaacgagaagcaggaagcgggtttacttaaaaaaaaaaaaaaaaaaagggaagtgctgtcatggagtgtggacctcagccctttcgctgtgtttgttgggctttttattagttttttcgagggaaggggtccagatcggcagcgcatcgttcactttttgttttacatactagtatttggcccaggagtaggcccacggagaccagcatgttccattgagtggttttgggtga

SEQ ID NO: 301469 - DNA, 7566 bp, Homo sapiens
gcgcggaggcagggaaccggagccttggagcgacccaacccctcgtctcgctgccctcccgcgcctgcaacggtgcgcggagactccggcgaactcagacacccaacggcggagaacagaagcggcaggcggcggacgtggcccggaagctgcgcgccgaacgcagcgcacccgctgccgagcagaggagccgcgcctttccccgaccctcggctccagcccccggcgcctgccgcctcgcagcccctctgcgtcctcggctcgggggccggcaccggcgatgccgagcggacgctccagtcctccgacccgctgaagaagcagcagccgctcgcccggagcctacggggattgtgcgagcggatcgtgctcggtggaggctcgggctgcggggcgcggggactccggggggcggggggagggaccgctctgtcggtgcccggcgccagccgcggctttgaagggtctccctcccctgcccttagcagctctgccacggactccgggaggctgcgggcggcgtcctgagggctccccagcagacccaatcggacttgagaaggtgatcgctctgctctcccaacccccttccctccccattccccccacttaactttttgtctccgttcatccgcggcttcgtcccctccccggcagacccacccgcggctgtgacaaccgcccggggcatgggccccccaacacggctcctagaggccccgcggcctcgcaagatgtgagaggccctccccgggcagaatcggagcttcaggagaggagctaataccccgccccccgtccctcacatcaggcggggtggaggtgcgcgctgagcccccgcggtgctgagcgtcccggagcgcccaatcctgggctggaacgagtagctggccggaggcgcgccgcggagagccggctgtcatgccctattgatccccctctgccccccgccaagtatgtttgggctggaccaattcgagccccaggtcaacagcaggaacgctggccagggcgagaggaactttaacgagaccggactgagcatgaacacccactttaaggccccggctttccacactggggggccccctggccctgtggatcctgctatgagcgcgctggggcaacccccgatcttgggcatgaacatggagccctacggcttccacgcgcgcggccactcggagttgcacgcaggggggctgcaagcgcagcctgtgcacggcttctttggcggccagcagcctcaccacggccacccgggaagtcatcatccccaccagcatcacccccactttgggggcaacttcggtggcccggaccccggggcctcgtgcctgcacgggggtcgcctgctcggctacggcggcgcagccggaggcctgggcagccagccgcccttcgccgagggctatgagcacatggcggagagccaggggcctgagagcttcggcccgcagcgaccggggaacctcccggacttccacagttcaggtgcctccagccaccgcgtgccggccccatgcctgccgctggaccagagccctaaccgagccgcctccttccacggcctgccgtcctccagcggctccgattcccacagtctggagccacggagggtgacgaaccaaggagccgtcgactcgctggaatacaattaccgggcgaggcgccctcgggacattttgacatgttttcgccctctgactccgaagggcagctgcctcattatgcagcgggtcgccaggttcctggggggcggctttcccggggcgccctcggccatgcccagagctgcgggcatggtgggcttgtccaaaatgcacgcccagccaccgcagcagcagccccagcagcagcagcagccccagcagcagcagcagcatggtgtgttctttgagaggttcagtggggccagaaagatgcctgtgggtctggagccctcagtgggctccaggcacccgttaatgcagcctccccagcaggccccgccaccccctcagcagcagcccccgcagcagccgccacagcagcagccgccgccgccacccgggcttctagtccgacaaaattcgttgcccgcctgcgctccctcggccccagcagggcgaggcgggcacgcccagcggcggcctgcaggacggaggccccatgctgcccagccagcacgcgcaattcgagtatcccatccaccggctggagaaccggagcatgcacccttattccgagcctgttttcagcatgcagcatcctcctccgcagcaggcgcccaaccagcggctgcagcatttcgacgcgcccccctacatgaacgtggccaagaggcgcgcttcgactttccgggcagcgcgggagtggaccgctgcgcttcgtggaacggcagcatgcacaacggcgctctggataatcacctctccccttccgcctacccaggcctacccggcgagttcacaccgcctgtgcccgacagcttcccttcggggccgcccctgcagcatccggccccggaccaccagtccctgcaacagcagcagcagcagcagcagcagcagcaacagcagcagcagcagcagcaacagcaacagcaacagcagcagcagcagcagcgccaaaacgcggccctcatgattaagcagatggcgtcgcggaatcagcagcagcggctgcgccagcccaacctggctcagctaggccaccccggggacgtgggccagggcggcctggtgcatggcggcccggtgggcggcttggcccagccgaactttgagcgcgaaggcggcagcacgggcgccgggcgtctgggcaccttcgagcagcaggcgccgcacttggcgcaagagagcgcgtggttctcaggtccgcatccgccgcccggagacctgctgccccgtaggatgggcggctcgggtctgcccgctgactgtggcccgcacgaccccagcctggcgccccctcctccgcctggtggctcgggggtgctgttccggggccctctgcaggagccgatgaggatgcccggagaggccacgtgccgcgctgccttcaccggcctgcagttcgggggcagtctgggaggcctgggtcagctgcagtcgcccggggcgggcgtggggctccccagcgctgcttcggagcgccggcccccgccgccggactttgctacgtctgcgctcgggggccagccgggctttccgtttggtgcagccggccggcagtccacgccgcacagcggtccaggcgtgaactcgccccccagcgcgggagggggcggtggcagctctggtggcggcggtggcgggggtgcctacccgccgcagcctgatttccagcccagccagcgcacctcggccagtaaattgggcgcgctctcgctgggctccttcaacaagcccagctccaaggacaacctgttcggccagagctgcctggctgcgctctccaccgcttgccagaacatgatcgccagcctcggggcccccaacctcaacgtgaccttcaacaagaagaacccgccagagggcaagaggaaactgagccagaacgagaccgacggcgcggcagtggccggcaacccgggctcggattacttcccaggagggactgctcctgggggccccaggacccggaggccgtccgggaccagtagcagcggctccaaagcctcggggccgcccaaccctccagcccagggggacggcaccagcctctcccccaactacaccctggaatccacgtcggggaatgacggcaagccggtctccgggggcggcggccggggacggggtcgcagaaaaagggacagtggtcacgtgagccctggcaccttctttgacaagtactcggcggctccggacagcgggggcgcacctggggtgagcccagggcagcagcaagcgtcaggcgcagccgtcgggggaagctccgcaggcgagacgcgcggggcaccgacgccccacgaaaaggcgctcacgtcgccatcctgggggaagggggctgagttgctcctgggggatcagccggacctcattgggtccctggacggcggggccaagtcggacagtagttcgccaaacgtgggtgagttcgcctcggacgaggtgagcacgagctacgccaatgaggacgaggtgtcgtccagctctgacaacccccaggcactagttaaagcgagcaggagtcccctggtgaccggctcgcccaaactccctccccgtggggtaggcgccggggaacacggaccgaaggcgcccccgcccgccctcggcctgggcatcatgtctaactctacctcgacccctgacagctacggcggcggtgggggcccgggccatccgggcactccgggcctggagcaggtccgcaccccgacgagcagcagcggcgccccgccacccgacgagatccaccccctggagatccttcaggcgcagatccagctacagaggcagcagttcagcatctccgaggaccagcctctggggctgaagggtggcaagaagggtgagtgcgccgtcggggcctcaggggcgcagaatggcgacagcgagctgggcagctgctgctccgaggcggtcaagagcgccatgagcaccattgacctggactcgctgatggcagagcacagcgctgcctggtacatgcccgctgacaaggccctggtggacagcgcggacgacgacaagacgttggcgccctgggagaaggccaaaccccagaaccccaacagcaaagaagcccacgacctccctgcaaacaaggcctcagcatcccagcctggcagccacttgcagtgcctgtctgtccactgcacagacgacgtgggtgacgccaaggctcgagcctccgtgcccacctggcggtccctgcattctgacatctccaacagatttgggacattcgtggctgccctaacttgaatgacaagaaagatcccctcctctaccaggcccttcctctccccctgtctgtttccttccccctcaaccttaccccacccctctgttaatttgaaagggccactattgctgagtggatgagttttttttttttcctctaggttggtacctgcttagtggcatatggaccggaaagggttaatttaaagggggggaacctcaaaagtttttttaaaaaagaaacttgtctgccacagtatgttaccagtgttaacccttctgcagttagcaaacttttgcttaagcctttttcctctagatactccccatgtttcggtaatcttggcatacattttttagatgacctctttccttgttttgttttcatgctgctgtatgtccaagtattgttatttcataataagacaagagttgctttcttttttattctttttccttttcttaccccctccccttttattttctttttgctttgttcactgcttattaaaatggaaatcctggagaatagtagttctggaatattgccgggtgaaagtccaattgtcatcacaatgttatatattgacaccccagtgtcatcagtcaggcaggagccaaacaatgaatgcccctcttaggtattccgcctgggattttgttttgtctgttccctaagaaaatatattttcattcctgcaaacacagtgctcagccttcagttcccttccacttgagttctctcttctcctgctggaagccgcccctctctgcgatggacgtgaggacgtgtccagctctgctctgtgggaaggagttggaatgttcgacagcagtgttttctctccttttctgggcctcctcgcaaatgcccaggccctgcattttcacgctgtgctaagcagcctttggtctgcatgggggatggtgtgctcccagcctgcagtctttggagcaaggctgctgcccgtgccttgggtgctggagttggaggaggctgttctcagccctttcccttttctgaaagctgttcctggccgggcatcccagggaagaaggaggggactgcgtgtatctcctccacctctcccattccatccccagtccagcctgggcaaccccacccctgggagggatgaggcaccctcttgctcagcctgctcagccttctctgagcctttgcagggatctgcagactcctgagggctagaggacagagaaagagaatagaatgaaatgactttgattcctgcgccttttagttttgaactctggaattcctctgccccctccccaacatttttttggaatctcaccctgttgcaaaactagagccatgtcccaagcatctcacaaaggaataactgctctgagcagagatgagtggtggttggcaggggcaggcaactttgggtgctgctgatgcctgcaaaagccatttatggcttgtggtggggggcacatagattccccggtgggttagacaggaagtaactgatatcacttcacccaaatatataaccgtgatggttatctatttaatttcagtttttgttaacgagcgtgtcttactaaaacgctccactttgagctcccccaccccctccaggtcctcagagtttgcagatctgggctttctaaagcaagtgacctgaaggctctgggctcaccatacaacacccacgttgtttatttcaaagaacttttcagcgaagggagaggagctttcagaaaaacctcactctttcccctcccttctcccctctttccttctgccggtccttttggctggggtctgagtctgcggttctcgcctgggcagtcttgacgaggagcaaaccccgccttcagagggcagacaaagcaggtggcatgaattgatcagcgagaaaggtgtgagccgaggcagttcctgcgttctgctacaaaaggaatggaaagggaagggaatttccccccaccatgggctgtgggagagttgaccgtattctgggcaagactccatgacccctctgattctgcagtgtacagctgtttgagagcctcatcattttacttttgaaacaggaatgatttctccttaattgcttaaggccggggagcaaagtgtcttaacttctgtctttgactttcccagcgttgagtcatcaacactttgccaattagctcatggtcctggcaacctcagaaacccctgaagttttaaaaactttctcgctccccacgaccccagaatgaaacagctttaaaaatagccttaagcaaaaggatgttatttcattaaatttggtttaatggaaagaataaaagtaaatgaaaaacacaccctacacactagactccgaacactggtaatcagtactgcatagcaaactctttgggaaagaaaacgaaaatgttattgcacatgtaaaatatgaaaacttaactctgctgtgtgttaggcaatcctgtaatcttttttgactcttaaaagaaattcatttctgaaatgcttggttggaagactgtgacaatagctcatgaaattgagtgttatttttttctttcttttttaaaaaaatatgtaaagtgcagtcttctgtattcctgcatattgtatatacctgtatatgttttcctgagcagttaaataacaataaatatgacgttaatggtgaaaaaaaaatat

SEQ ID NO: 301470 - DNA, 7019 bp, Homo sapiens
gcgcggaggcagggaaccggagccttggagcgacccaacccctcgtctcgctgccctcccgcgcctgcaacggtgcgcggagactccggcgaactcagacacccaacggcggagaacagaagcggcaggcggcggacgtggcccggaagctgcgcgccgaacgcagcgcacccgctgccgagcagaggagccgcgcctttccccgaccctcggctccagcccccggcgcctgccgcctcgcagcccctctgcgtcctcggctcgggggccggcaccggcgatgccgagcggacgctccagtcctccgacccgctgaagaagcagcagccgctcgcccggagcctacggggattgtgcgagcggatcgtgctcggtggaggctcgggctgcggggcgcggggactccggggggcggggggagggaccgctctgtcggtgcccggcgccagccgcggctttgaagggtctccctcccctgcccttagcagctctgccacggactccgggaggctgcgggcggcgtcctgagggctccccagcagacccaatcggacttgagaaggtgatcgctctgctctcccaacccccttccctccccattccccccacttaactttttgtctccgttcatccgcggcttcgtcccctccccggcagacccacccgcggctgtgacaaccgcccggggcatgggccccccaacacggctcctagaggccccgcggcctcgcaagatgtgagaggccctccccgggcagaatcggagcttcaggagaggagctaataccccgccccccgtccctcacatcaggcggggtggaggtgcgcgctgagcccccgcggtgctgagcgtcccggagcgcccaatcctgggctggaacgagtagctggccggaggcgcgccgcggagagccggctgtcatgccctattgatccccctctgccccccgccaagtatgtttgggctggaccaattcgagccccaggtcaacagcaggaacgctggccagggcgagaggaactttaacgagaccggactgagcatgaacacccactttaaggccccggctttccacactggggggccccctggccctgtggatcctgctatgagcgcgctggggcaacccccgatcttgggcatgaacatggagccctacggcttccacgcgcgcggccactcggagttgcacgcaggggggctgcaagcgcagcctgtgcacggcttctttggcggccagcagcctcaccacggccacccgggaagtcatcatccccaccagcatcacccccactttgggggcaacttcggtggcccggaccccggggcctcgtgcctgcacgggggtcgcctgctcggctacggcggcgcagccggaggcctgggcagccagccgcccttcgccgagggctatgagcacatggcggagagccaggggcctgagagcttcggcccgcagcgaccggggaacctcccggacttccacagttcaggtgcctccagccaccgcgtgccggccccatgcctgccgctggaccagagccctaaccgagccgcctccttccacggcctgccgtcctccagcggctccgattcccacagtctggagccacggagggtgacgaaccaaggagccgtcgactcgctggaatacaattaccgggcgaggcgccctcgggacattttgacatgttttcgccctctgactccgaagggcagctgcctcattatgcagcgggtcgccaggttcctggggggcggctttcccggggcgccctcggccatgcccagagctgcgggcatggtgggcttgtccaaaatgcacgcccagccaccgcagcagcagccccagcagcagcagcagccccagcagcagcagcagcatggtgtgttctttgagaggttcagtggggccagaaagatgcctgtgggtctggagccctcagtgggctccaggcacccgttaatgcagcctccccagcaggccccgccaccccctcagcagcagcccccgcagcagccgccacagcagcagccgccgccgccacccgggcttctagtccgacaaaattcgttgcccgcctgcgctccctcggccccagcagggcgaggcgggcacgcccagcggcggcctgcaggacggaggccccatgctgcccagccagcacgcgcaattcgagtatcccatccaccggctggagaaccggagcatgcacccttattccgagcctgttttcagcatgcagcatcctcctccgcagcaggcgcccaaccagcggctgcagcatttcgacgcgcccccctacatgaacgtggccaagaggcgcgcttcgactttccgggcagcgcgggagtggaccgctgcgcttcgtggaacggcagcatgcacaacggcgctctggataatcacctctccccttccgcctacccaggcctacccggcgagttcacaccgcctgtgcccgacagcttcccttcggggccgcccctgcagcatccggccccggaccaccagtccctgcaacagcagcagcagcagcagcagcagcagcaacagcagcagcagcagcagcaacagcaacagcaacagcagcagcagcagcagcgccaaaacgcggccctcatgattaagcagatggcgtcgcggaatcagcagcagcggctgcgccagcccaacctggctcagctaggccaccccggggacgtgggccagggcggcctggtgcatggcggcccggtgggcggcttggcccagccgaactttgagcgcgaaggcggcagcacgggcgccgggcgtctgggcaccttcgagcagcaggcgccgcacttggcgcaagagagcgcgtggttctcaggtccgcatccgccgcccggagacctgctgccccgtaggatgggcggctcgggtctgcccgctgactgtggcccgcacgaccccagcctggcgccccctcctccgcctggtggctcgggggtgctgttccggggccctctgcaggagccgatgaggatgcccggagaggccacgtgccgcgctgccttcaccggcctgcagttcgggggcagtctgggaggcctgggtcagctgcagtcgcccggggcgggcgtggggctccccagcgctgcttcggagcgccggcccccgccgccggactttgctacgtctgcgctcgggggccagccgggctttccgtttggtgcagccggccggcagtccacgccgcacagcggtccaggcgtgaactcgccccccagcgcgggagggggcggtggcagctctggtggcggcggtggcgggggtgcctacccgccgcagcctgatttccagcccagccagcgcacctcggccagtaaattgggcgcgctctcgctgggctccttcaacaagcccagctccaaggacaacctgttcggccagagctgcctggctgcgctctccaccgcttgccagaacatgatcgccagcctcggggcccccaacctcaacgtgaccttcaacaagaagaacccgccagagggcaagaggaaactgagccagaacgagaccgacggcgcggcagtggccggcaacccgggctcggattacttcccaggagggactgctcctgggggccccaggacccggaggccgtccgggaccagtagcagcggctccaaagcctcggggccgcccaaccctccagcccagggggacggcaccagcctctcccccaactacaccctggaatccacgtcggggaatgacggcaagccggtctccgggggcggcggccggggacggggtcgcagaaaaagggacagtggtcacgtgagccctggcaccttctttgacaagtactcggcggctccggacagcgggggcgcacctggggtgagcccagggcagcagcaagcgtcaggcgcagccgtcgggggaagctccgcaggcgagacgcgcggggcaccgacgccccacgaaaaggcgctcacgtcgccatcctgggggaagggggctgagttgctcctgggggatcagccggacctcattgggtccctggacggcggggccaagtcggacagtagttcgccaaacgtgggtgagttcgcctcggacgaggtgagcacgagctacgccaatgaggacgaggtgtcgtccagctctgacaacccccaggcactagttaaagcgagcaggagtcccctggtgaccggctcgcccaaactccctccccgtggggtaggcgccggggaacacggaccgaaggcgcccccgcccgccctcggcctgggcatcatgtctaactctacctcgacccctgacagctacggcggcggtgggggcccgggccatccgggcactccgggcctggagcaggtccgcaccccgacgagcagcagcggcgccccgccacccgacgagatccaccccctggagatccttcaggcgcagatccagctacagaggcagcagttcagcatctccgaggaccagcctctggggctgaagggtggcaagaagggtgagtgcgccgtcggggcctcaggggcgcagaatggcgacagcgagctgggcagctgctgctccgaggcggtcaagagcgccatgagcaccattgacctggactcgctgatggcagagcacagcgctgcctggtacatgcccgctgacaaggccctggtggacagcgcggacgacgacaagacgttggcgccctgggagaaggccaaaccccagaaccccaacagcaaagaagcccacgacctccctgcaaacaaggcctcagcatcccagcctggcagccacttgcagtgcctgtctgtccactgcacagacgacgtgggtgacgccaaggctcgagcctccgtgcccacctggcggtccctgcattctgacatctccaacagatttgggacattcgtggctgccctaacttgaatgacaagaaagatcccctcctctaccaggcccttcctctccccctgtctgtttccttccccctcaaccttaccccacccctctgttaatttgaaagggccactattgctgagtggatgagttttttttttttcctctagtgctcagccttcagttcccttccacttgagttctctcttctcctgctggaagccgcccctctctgcgatggacgtgaggacgtgtccagctctgctctgtgggaaggagttggaatgttcgacagcagtgttttctctccttttctgggcctcctcgcaaatgcccaggccctgcattttcacgctgtgctaagcagcctttggtctgcatgggggatggtgtgctcccagcctgcagtctttggagcaaggctgctgcccgtgccttgggtgctggagttggaggaggctgttctcagccctttcccttttctgaaagctgttcctggccgggcatcccagggaagaaggaggggactgcgtgtatctcctccacctctcccattccatccccagtccagcctgggcaaccccacccctgggagggatgaggcaccctcttgctcagcctgctcagccttctctgagcctttgcagggatctgcagactcctgagggctagaggacagagaaagagaatagaatgaaatgactttgattcctgcgccttttagttttgaactctggaattcctctgccccctccccaacatttttttggaatctcaccctgttgcaaaactagagccatgtcccaagcatctcacaaaggaataactgctctgagcagagatgagtggtggttggcaggggcaggcaactttgggtgctgctgatgcctgcaaaagccatttatggcttgtggtggggggcacatagattccccggtgggttagacaggaagtaactgatatcacttcacccaaatatataaccgtgatggttatctatttaatttcagtttttgttaacgagcgtgtcttactaaaacgctccactttgagctcccccaccccctccaggtcctcagagtttgcagatctgggctttctaaagcaagtgacctgaaggctctgggctcaccatacaacacccacgttgtttatttcaaagaacttttcagcgaagggagaggagctttcagaaaaacctcactctttcccctcccttctcccctctttccttctgccggtccttttggctggggtctgagtctgcggttctcgcctgggcagtcttgacgaggagcaaaccccgccttcagagggcagacaaagcaggtggcatgaattgatcagcgagaaaggtgtgagccgaggcagttcctgcgttctgctacaaaaggaatggaaagggaagggaatttccccccaccatgggctgtgggagagttgaccgtattctgggcaagactccatgacccctctgattctgcagtgtacagctgtttgagagcctcatcattttacttttgaaacaggaatgatttctccttaattgcttaaggccggggagcaaagtgtcttaacttctgtctttgactttcccagcgttgagtcatcaacactttgccaattagctcatggtcctggcaacctcagaaacccctgaagttttaaaaactttctcgctccccacgaccccagaatgaaacagctttaaaaatagccttaagcaaaaggatgttatttcattaaatttggtttaatggaaagaataaaagtaaatgaaaaacacaccctacacactagactccgaacactggtaatcagtactgcatagcaaactctttgggaaagaaaacgaaaatgttattgcacatgtaaaatatgaaaacttaactctgctgtgtgttaggcaatcctgtaatcttttttgactcttaaaagaaattcatttctgaaatgcttggttggaagactgtgacaatagctcatgaaattgagtgttatttttttctttcttttttaaaaaaatatgtaaagtgcagtcttctgtattcctgcatattgtatatacctgtatatgttttcctgagcagttaaataacaataaatatgacgttaatggtgaaaaaaaaatat

SEQ ID NO: 301471 - DNA, 732 bp, Homo sapiens
ggacaaatatacatccataaaataaccacttcaaagctgaataattattgcttcctttctttatagacttaaaaataataaattggctttcatttttcttccaatctccaacagattgaagaagagatgttggctttgcagaatgagcgcacagaacgaatacgaagcctgttggaacgtcaagccagagagattgaagcttttgactctgaaagcatgagactaggttttagtaatatggtcctttctaatctctcccctgaggcattcagccacagctacccgggagcttctggttggtcacacaaccctactgggggtccaggacctcactggggtcatcccatgggtggcccaccacaagcttggggccatccaatgcaaggtggaccccagccatggggtcacccttcagggccaatgcaaggggtacctcgaggtagcagtatgggagtccgcaatagcccccaggctctgaggcggacagcttctgggggacggacggagcagggcatgagcagaagcacgagtgtcacttcacaaatatccaatgggtcacacatgtcttatacataacttaataattgagagtggcaattccgctggagctgtctgccaaaagaactggttcgacatatacaggaacttcttattggggccacaaggtggaactgagcgtattggtaattattcattttgtgaacggtccggttgggttactaattggaggga

SEQ ID NO: 301472 - DNA, 2304 bp, Homo sapiens
ggacaaatatacatccataaaataaccacttcaaagctgaataattattgcttcctttctttatagacttaaaaataataaattggctttcatttttcttccaatctccaacagattgaagaagagatgttggctttgcagaatgagcgcacagaacgaatacgaagcctgttggaacgtcaagccagagagattgaagcttttgactctgaaagcatgagactaggttttagtaatatggtcctttctaatctctcccctgaggcattcagccacagctacccgggagcttctggttggtcacacaaccctactgggggtccaggacctcactggggtcatcccatgggtggcccaccacaagcttggggccatccaatgcaaggtggaccccagccatggggtcacccttcagggccaatgcaaggggtacctcgaggtagcagtatgggagtccgcaatagcccccaggctctgaggcggacagcttctgggggacggacggagcagggcatgagcagaagcacgagtgtcacttcacaaatatccaatgggtcacacatgtcttatacataacttaataattgagagtggcaattccgctggagctgtctgccaaaagaaactgcctacagacatcatcacagcagcctcctcacttgggtactacagtgtggaagctgagtgcatatggtatattttattcatttttgtaaagcgttctgttttgtgtttactaattgggatgtcatagtacttggctgccgggtttgtttgtttttggggaaattttgaaaagtggagttgatattaaaaataaatgtgtatgtgtgtacatatatatacacacacatacacatatattatgcatgtggtgaaaagaattggctagataggggatttttctgaacactgcaaaaatagaacgtagcaaaatggcttcagttatcacttttgggtgtctgtatcctaagaagtttctgaaaagatctaaagcctttttatcccatatcccaaattcttatgagccactcacagcaggcagcatatgttgaaataagttattactggtacacacctgcattgcctcaccagtgtatttatttgttattaaattgatctgacttctcagcctcatttggactaaaaaaagaaagcagaaatccatgaacacattgcttctcggccttttggctaagatcaagtgtagaaatccatgaacactaaaggacttcattgattttttcagagagtagaaaacaacttagtttttcttttttcctgaatgcgtcataggcttgtgagtgatttttgtccattcaattgtgccttctttgtattatgataagatgggggtacttaaggagatcacaagttgtgtgaggattgcattaacaaacctatgagccttcaatggggaagaccagaagggtgagaggggccctgaaagttcatatggtgggtatgtcccgcagcagagtgaggagatgaagcttacgtgtcctgacgttttgttgcttatactgtgatatctcatcctagctaagctctataatgcccaagaccccaaacagtacttttactttgtttgtacaaaaacaaagacatatagccaatacaaatcaaatgccggaggtgtttgatgccatatttgcaaattgccatctattgaaattctcgtcacactacatagacataattgttatctccttttggcttatgtgattttctgtttacaagtagaatagccaattatttaaatgtttagttgccacagtgaaccaggagtcactgagccaatgactttaccagctgctgactaatcttcatcaccactgtagattttgctgcatgtgcaggtcctctatttttaattgctgttttcgttgctgcagtactttacaaacttctagttcgttgagacttagtgaccatttggcatcaagttaacatcacacaataggaaacaccacttccacaagtctcaagcctcagtgctaaagtactactgaaaaggaactaggaagtttggccaattaaaaaaaaaaagtaaaataagttatagtggtcagggaatctcttgacgaaagctaactcttatttttcagggggcacatgttttgttttgttatgttttgttgtacaatgaaggatgaacccaatgctaaaaagtcagttattttcttggttttccatttcttgtatataaattgtgttggaggtgggtaggaagctgtgagtatgacttgaagaaaaatatccttttcagtgacaaatcagagtttcttacaagttattgtcctg

SEQ ID NO: 301473 - DNA, 1808 bp, Homo sapiens
ggacaaatatacatccataaaataaccacttcaaagctgaataattattgcttcctttctttatagacttaaaaataataaattggctttcatttttcttccaatctccaacagattgaagaagagatgttggctttgcagaatgagcgcacagaacgaatacgaagcctgttggaacgtcaagccagagagattgaagcttttgactctgaaagcatgagactaggttttagtaatatggtcctttctaatctctcccctgaggcattcagccacagctacccgggagcttctggttggtcacacaaccctactgggggtccaggacctcactggggtcatcccatgggtggcccaccacaagcttggggccatccaatgcaaggtggaccccagccatggggtcacccttcagggccaatgcaaggggtacctcgaggtagcagtatgggagtccgcaatagcccccaggctctgaggcggacagcttctgggggacggacggagcagggcatgagcagaagcacgagtgtcacttcacaaatatccaatgggtcacacatgtcttatacataacttaataattgagagtggcaattccgctggagctgtctgccaaaagaaactgcctacagacatcatcacagcagcctcctcacttgggtactacagtgtggaagctgagtgcatatggtatattttattcatttttgtaaagcgttctgttttgtgtttactaattgggatgtcatagtacttggctgccgggtttgtttgtttttggggaaattttgaaaagtggagttgatattaaaaataaatgtgtatgtgtgtacatatatatacacacacatacacatatattatgcatgtggtgaaaagaattggctagataggggatttttctgaacactgcaaaaatagaacgtagcaaaatggcttcagttatcacttttgggtgtctgtatcctaagaagtttctgaaaagatctaaagcctttttatcccatatcccaaattcttatgagccactcacagcaggcagcatatgttgaaataagttattactggtacacacctgcattgcctcaccagtgtatttatttgttattaaattgatctgacttctcagcctcatttggactaaaaaaagaaagcagaaatccatgaacacattgcttctcggccttttggctaagatcaagtgtagaaatccatgaacactaaaggacttcattgattttttcagagagtagaaaacaacttagtttttcttttttcctgaatgcgtcataggcttgtgagtgatttttgtccattcaattgtgccttctttgtattatgataagatgggggtacttaaggagatcacaagttgtgtgaggattgcattaacaaacctatgagccttcaatggggaagaccagaagggtgagaggggccctgaaagttcatatggtgggtatgtcccgcagcagagtgaggagatgaagcttacgtgtcctgacgttttgttgcttatactgtgatatctcatcctagctaagctctataatgcccaagaccccaaacagtacttttactttgtttgtacaaaaacaaagacatatagccaatacaaatcaaatgccggaggtgtttgatgccatatttgcaaattgccatctattgaaattctcgtcacactacatagacataattgttatctccttttggcttatgtgattttctgtttacaagtagaataccctatcaatgtttaatatgtattcacctcagttatccaggattccctgaaacaatgaact

SEQ ID NO: 301474 - DNA, 1940 bp, Homo sapiens
  misc_feature (44)..(44): n is a, c, g, or t
  misc_feature (562)..(562): n is a, c, g, or t
  misc_feature (798)..(798): n is a, c, g, or t
tttgctctcttatgttactggttttgaaaacatttatatttacntgtgtctaagaatgtgtgcttatgtgtacttgcttcctagctttagaatctgcttagaatctgcaccttacctaaaatttccagtgtgtaaaatgaacatattacttatataaaccacatgggactgaacttttcatgagagcccccaaagtttccttcgtggagagattgaagctggaggaaatgaatttggcttataaaagatatgaggcatttaacagcaattggagccaaacttggtgttctttctgatttttttaaaattaatataccagaggaatcataaaatgttatggaacttatttcctcaagttctggaaatcattgggttaaacatagctaatttcccccttatgttattatagagtttatatttatattacaaagaaacgcaagcaataaatcctcattcagaatccttctctagcacattaaatatagcatgtgaactgtagagatttacctaaagtgcccataaacaagagtggccaacttgatgagaagtaagccaagtgccncttaataagtactgtaataacatagcctcctggaatggtctttcatcattttgtcaagaggaacttttatccctgtttatataaagctcctttgctaaatgaaacaagcaaaatgtatattcagcaattgttgacagagcaatgttgatagaaatgcaatgggggcccaacgacagctcctctttccaaagtggcttctgtgttttaaaaagatcttttgcttcaatcaggataanttccaagatattatgaaggaggtaatgtacttctccattcagtctatgataatgggatcctaattaacacctagtaggcctactgaaacaagcacctctataataagaggaagattctacatgaatatccaacctacttaacctttagggatttatttttacaatgtaagaaagtgataaagtcaccttcaaaaagttctaagtcagtacttaaaagtatttgatcaattgctttgtttcatgaagtaacattttacaattttaagtcacaactataaatttgttcatcccaaaccaagttatttcatgtcttaagatgtataattctagatgttttcatatgttataactattaaaaagttgaggctggacatggtggctcatgcctgtaatcccaacactttggaattacactttgggcatagatggggagatctcttgagcccaggagttggagagcagcctgggcaacacggcgaagggaggatcgcttgagcccaggaggttgaggctgcagtaagccttgattgcgccattgcactccagcctgggcaacagagcaagaacctgtctcaaaaaattttaagttgatctttctttctctacaattctattagtaaggctaaaaacaaaaccactaactttgcataaaacagcattccaatttaatctcaagctaacagttgactttgaaacatgctcttaatatttggtgcaggacatttcaaagctgagccctcttgcattgcctttttcagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaatattaaactgattatttcattctaaaaaaaaaaaag

SEQ ID NO: 301475 - DNA, 9644 bp, Homo sapiens
cagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccagagacacccgattacaaatgctattgatggaaagaacacttggtggcagagtcccagtattaagaatggaatcgaataccattatgtgacaattacactggatttacagcaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagatattactactcggtcaaggatatttcagttggagggatgtgcatctgctatggtcatgccagggcttgtccacttgatccagcgacaaataaatctcgctgtgagtgtgagcataacacatgtggcgatagctgtgatcagtgctgtccaggattccatcagaaaccctggagagctggaacttttctaactaaaactgaatgtgaagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtacagatggcttcttcagacccaaaggggtatctccaaattatccaaggccatgccagccatgtcattgcgatccaattggttccttaaatgaagtctgtgtcaaggatgagaaacatgctcgacgaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaaatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaactcccagcagtaggaggacagttgacatttaccatatcatatgaccttgaagaagaggaagaagatacagaacgtgttctccagcttatgattatcttagagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggttgagctctgttaaccttgaatccgctgtctcctatcctactgatggaagcattgcagcagctgtagaagtgtgtcagtgcccaccagggtatactggctcctcttgtgaatcttgttggcctaggcacaggcgagttaacggcactatttttggtggcatctgtgagccatgtcagtgctttggtcatgcggagtcctgtgatgacgtcactggagaatgcctgaactgtaaggatcacacaggtggcccatattgtgataaatgtcttcctggtttctatggcgagcctactaaaggaacctctgaagactgtcaaccctgtgcctgtccactcaatatcccatccaataactttagcccaacgtgccatttagaccggagtcttggattgatctgtgatggatgccctgtcgggtacacaggaccacgctgtgagaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagccctgtcgctgtaatgccggtggctctttctctgaggtttgccacagtcaaactggacagtgtgagtgcagagccaacgttcagggtcagagatgtgacaaatgcaaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacagcttgtgaatgttctcatctgggtaataattgtgacccaaagactgggcgatgcatttgcccacccaataccattggagagaaatgttctaaatgtgcacccaatacctggggccacagcattaccactggttgtaaggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagagaaagaatggaaatattatggggatgatcctcgagtccatagaactgtgacccgagaagacttcttggatatactatatgatattcattacattcttatcaaagctacttatggaaatttcatgcgacaaagcaggatttctgaaatctcaatggaggtagctgaacaaggacgtggaacaacaatgactcctccagctgacttgattgaaaaatgtgattgtcccctgggctattctggcctgtcctgtgaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccagaattgtcaacatcacactgctggtgacttctgtgaacgatgtgctcttggatactatggaattgtcaagggattgccaaatgactgtcagcaatgtgcctgccctctgatttcttccagtaacaatttcagcccctcttgtgtcgcagaaggacttgacgactaccgctgcacggcttgtccacggggatatgaaggccagtactgtgaaaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgttttttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaagcacttgctgtcacctcagcgggccccagagaggcttattcagctggcagagggcaatctgaatacactcgtgaccgaaatgaacgagctgctgaccagggctaccaaagtgacagcagatggcgagcagaccggacaggatgctgagaggaccaacacaagagcaaagtccctgggagaattcattaaggagcttgcccgggatgcagaagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggagaaaaagaaggaggctgttgagagcggcaaacgacaaattgagaacactttaaaagaaggcaatgacatactcgatgaagccaaccgtcttgcagatgaaatcaactccatcatagactatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatggaatccttgatgaggctaaaaacatctccttcaatgccactgcagccttcaaagcttacagcaatattaaggactatattgatgaagctgagaaagttgccaaagaagccaaagatcttgcacatgaagctacaaaactggcaacaggtcctcggggtttattaaaggaagatgccaaaggctgtcttcagaaaagcttcaggattcttaacgaagccaagaagttagcaaatgatgtaaaagaaaatgaagaccatctaaatggcttaaaaaccaggatagaaaatgctgatgctagaaatggggatctcttgagaactttgaatgacactttgggaaagttatcagctattccaaatgatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacaaaatcattgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttattgactttctggctatagaaatgcgtaaaggcaaagtcagcttcctctgggatgttggatctggagttggacgtgtagagtacccagatttgactattgatgactcatattggtaccgtatcgtagcatcaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaagaaggctgatgctgtacgtgtgattacattcactggctgcatgggagaaacatactttgacaacaaacctataggtttgtggaatttccgagaaaaagaaggtgactgcaaaggatgcactgtcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctgagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaagccaatatatcaattgtagatatagatactaatcaggaggagaatatagcaacttcgtcttctggaaacaactttggtcttgacttgaaagcagatgacaaaatatattttggtggcctgccaacgctgagaaacttgagtatgaaagcaaggccagaagtaaatctgaagaaatattccggctgcctcaaagatattgaaatttcaagaactccgtacaatatactcagtagtcccgattatgttggtgttaccaaaggatgttccctggagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggcctattatgtaatactcctcaacaggggccgtctggaagtgcatctctccacaggggcacgaacaatgaggaaaattgtcatcagaccagagccgaatctgtttcatgatggaagagaacattccgttcatgtagagcgaactagaggcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgcagaatcagaaccagctcttttgatagggagcaagcagttcgggctttcaagaaacagtcacattgcaattgcatttgatgacaccaaagttaaaaaccgtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcagttggtggattcaaagtgggattggaccttcttgtagaatttgaattccgcacaactacaacgactggagttcttctggggatcagtagtcaaaaaatggatggaatgggtattgaaatgattgatgaaaagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaatattaaactgattatttcattctaaaaaaaaaaaag

SEQ ID NO: 301476 - DNA, 9944 bp, Homo sapiens
cagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggcatagtaccaattctgtgtcaggcattttattcactttgtttcaactgttcttgagatcccggaggattaggactattgcagttataagtctataactgaggaaaggaagcttatctggacaggaagatatttagagtatgatataaagacagtctctttttaaaaacagcattttaaagtgagatgaacccggtacctcagatggaaaagcagaaatcacctgtcttctgcgtcgctcacgctgggagctgtagaccggagctgttcctattcggccatcttggctcctcccctaaaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccagagacacccgattacaaatgctattgatggaaagaacacttggtggcagagtcccagtattaagaatggaatcgaataccattatgtgacaattacactggatttacagcaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagatattactactcggtcaaggatatttcagttggagggatgtgcatctgctatggtcatgccagggcttgtccacttgatccagcgacaaataaatctcgctgtgagtgtgagcataacacatgtggcgatagctgtgatcagtgctgtccaggattccatcagaaaccctggagagctggaacttttctaactaaaactgaatgtgaagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtacagatggcttcttcagacccaaaggggtatctccaaattatccaaggccatgccagccatgtcattgcgatccaattggttccttaaatgaagtctgtgtcaaggatgagaaacatgctcgacgaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaaatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaactcccagcagtaggaggacagttgacatttaccatatcatatgaccttgaagaagaggaagaagatacagaacgtgttctccagcttatgattatcttagagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggttgagctctgttaaccttgaatccgctgtctcctatcctactgatggaagcattgcagcagctgtagaagtgtgtcagtgcccaccagggtatactggctcctcttgtgaatcttgttggcctaggcacaggcgagttaacggcactatttttggtggcatctgtgagccatgtcagtgctttggtcatgcggagtcctgtgatgacgtcactggagaatgcctgaactgtaaggatcacacaggtggcccatattgtgataaatgtcttcctggtttctatggcgagcctactaaaggaacctctgaagactgtcaaccctgtgcctgtccactcaatatcccatccaataactttagcccaacgtgccatttagaccggagtcttggattgatctgtgatggatgccctgtcgggtacacaggaccacgctgtgagaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagccctgtcgctgtaatgccggtggctctttctctgaggtttgccacagtcaaactggacagtgtgagtgcagagccaacgttcagggtcagagatgtgacaaatgcaaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacagcttgtgaatgttctcatctgggtaataattgtgacccaaagactgggcgatgcatttgcccacccaataccattggagagaaatgttctaaatgtgcacccaatacctggggccacagcattaccactggttgtaaggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagagaaagaatggaaatattatggggatgatcctcgagtccatagaactgtgacccgagaagacttcttggatatactatatgatattcattacattcttatcaaagctacttatggaaatttcatgcgacaaagcaggatttctgaaatctcaatggaggtagctgaacaaggacgtggaacaacaatgactcctccagctgacttgattgaaaaatgtgattgtcccctgggctattctggcctgtcctgtgaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccagaattgtcaacatcacactgctggtgacttctgtgaacgatgtgctcttggatactatggaattgtcaagggattgccaaatgactgtcagcaatgtgcctgccctctgatttcttccagtaacaatttcagcccctcttgtgtcgcagaaggacttgacgactaccgctgcacggcttgtccacggggatatgaaggccagtactgtgaaaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgttttttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaagcacttgctgtcacctcagcgggccccagagaggcttattcagctggcagagggcaatctgaatacactcgtgaccgaaatgaacgagctgctgaccagggctaccaaagtgacagcagatggcgagcagaccggacaggatgctgagaggaccaacacaagagcaaagtccctgggagaattcattaaggagcttgcccgggatgcagaagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggagaaaaagaaggaggctgttgagagcggcaaacgacaaattgagaacactttaaaagaaggcaatgacatactcgatgaagccaaccgtcttgcagatgaaatcaactccatcatagactatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatggaatccttgatgaggctaaaaacatctccttcaatgccactgcagccttcaaagcttacagcaatattaaggactatattgatgaagctgagaaagttgccaaagaagccaaagatcttgcacatgaagctacaaaactggcaacaggtcctcggggtttattaaaggaagatgccaaaggctgtcttcagaaaagcttcaggattcttaacgaagccaagaagttagcaaatgatgtaaaagaaaatgaagaccatctaaatggcttaaaaaccaggatagaaaatgctgatgctagaaatggggatctcttgagaactttgaatgacactttgggaaagttatcagctattccaaatgatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacaaaatcattgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttattgactttctggctatagaaatgcgtaaaggcaaagtcagcttcctctgggatgttggatctggagttggacgtgtagagtacccagatttgactattgatgactcatattggtaccgtatcgtagcatcaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaagaaggctgatgctgtacgtgtgattacattcactggctgcatgggagaaacatactttgacaacaaacctataggtttgtggaatttccgagaaaaagaaggtgactgcaaaggatgcactgtcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctgagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaagccaatatatcaattgtagatatagatactaatcaggaggagaatatagcaacttcgtcttctggaaacaactttggtcttgacttgaaagcagatgacaaaatatattttggtggcctgccaacgctgagaaacttgagtatgaaagcaaggccagaagtaaatctgaagaaatattccggctgcctcaaagatattgaaatttcaagaactccgtacaatatactcagtagtcccgattatgttggtgttaccaaaggatgttccctggagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggcctattatgtaatactcctcaacaggggccgtctggaagtgcatctctccacaggggcacgaacaatgaggaaaattgtcatcagaccagagccgaatctgtttcatgatggaagagaacattccgttcatgtagagcgaactagaggcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgcagaatcagaaccagctcttttgatagggagcaagcagttcgggctttcaagaaacagtcacattgcaattgcatttgatgacaccaaagttaaaaaccgtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcagttggtggattcaaagtgggattggaccttcttgtagaatttgaattccgcacaactacaacgactggagttcttctggggatcagtagtcaaaaaatggatggaatgggtattgaaatgattgatgaaaagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaatattaaactgattatttcattctaaaaaaaaaaaag

SEQ ID NO: 301477 - DNA, 2227 bp, Homo sapiens
tccagtcggtccggtgttatcgatgccaccaaaatatattttggtggcctgccaacgctgagaaacttgagtatgaaagcaaggccagaagtaaatctgaagaaatattccggctgcctcaaagatattgaaatttcaagaactccgtacaatatactcagtagtcccgattatgttggtgttaccaaaggatgttccctggagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggcctattatgtaatactcctcaacaggggccgtctggaagtgcatctctccacaggggcacgaacaatgaggaaaattgtcatcagaccagagccgaatctgtttcatgatggaagagaacattccgttcatgtagagcgaactagaggcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgcagaatcagaaccagctcttttgatagggagcaagcagttcgggctttcaagaaacagtcacattgcaattgcatttgatgacaccaaagttaaaaaccgtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcagttggtggattcaaagtgggattggaccttcttgtagaatttgaattccgcacaactacaacgactggagttcttctggggatcagtagtcaaaaaatggatggaatgggtattgaaatgattgatgaaaagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaatattaaactgattatttcattctaaaaaaaaaaaag

SEQ ID NO: 301478 - DNA, 2266 bp, Homo sapiens
tgtcattctcatacatttttaattatcctatcataatacaattattcattttgtctgctgcttctaatcaaaattatcttaaaccactccaatagaattagggaaatgaagggaaaatgtgggtaaagaaaaaagtaaatccaccacttgaatgatgaggtttaaagactggaacagaactttcaggatcttcattgttcatagctacaggctccaatttggaattggccatagacacccactaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggcctattatgtaatactcctcaacaggggccgtctggaagtgcatctctccacaggggcacgaacaatgaggaaaattgtcatcagaccagagccgaatctgtttcatgatggaagagaacattccgttcatgtagagcgaactagaggcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgcagaatcagaaccagctcttttgatagggagcaagcagttcgggctttcaagaaacagtcacattgcaattgcatttgatgacaccaaagttaaaaaccgtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcagttggtggattcaaagtgggattggaccttcttgtagaatttgaattccgcacaactacaacgactggagttcttctggggatcagtagtcaaaaaatggatggaatgggtattgaaatgattgatgaaaagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaatattaaactgattatttcattctaaaaaaaaaaaag

SEQ ID NO: 301479 - DNA, 1757 bp, Homo sapiens
aacctcctgggttttgccaacacatttttccatagtttggtaaagaaagaaacctcaaaacatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgcagaatcagaaccagctcttttgatagggagcaagcagttcgggctttcaagaaacagtcacattgcaattgcatttgatgacaccaaagttaaaaaccgtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcagttggtggattcaaagtgggattggaccttcttgtagaatttgaattccgcacaactacaacgactggagttcttctggggatcagtagtcaaaaaatggatggaatgggtattgaaatgattgatgaaaagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaatattaaactgattatttcattctaaaaaaaaaaaag

SEQ ID NO: 301480 - DNA, 9945 bp, Homo sapiens
cagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggcatagtaccaattctgtgtcaggcattttattcactttgtttcaactgttcttgagatcccggaggattaggactattgcagttataagtctataactgaggaaaggaagcttatctggacaggaagatatttagagtatgatataaagacagtctctttttaaaaacagcattttaaagtgagatgaacccggtacctcagatggaaaagcagaaatcacctgtcttctgcgtcgctcacgctgggagctgtagaccggagctgttcctattcggccatcttggctcctcccctaaaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccagagacacccgattacaaatgctattgatggaaagaacacttggtggcagagtcccagtattaagaatggaatcgaataccattatgtgacaattacactggatttacagcaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagatattactactcggtcaaggatatttcagttggagggatgtgcatctgctatggtcatgccagggcttgtccacttgatccagcgacaaataaatctcgctgtgagtgtgagcataacacatgtggcgatagctgtgatcagtgctgtccaggattccatcagaaaccctggagagctggaacttttctaactaaaactgaatgtgaagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtacagatggcttcttcagacccaaaggggtatctccaaattatccaaggccatgccagccatgtcattgcgatccaattggttccttaaatgaagtctgtgtcaaggatgagaaacatgctcgacgaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaaatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaactcccagcagtaggaggacagttgacatttaccatatcatatgaccttgaagaagaggaagaagatacagaacgtgttctccagcttatgattatcttagagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggttgagctctgttaaccttgaatccgctgtctcctatcctactgatggaagcattgcagcagctgtagaagtgtgtcagtgcccaccagggtatactggctcctcttgtgaatcttgttggcctaggcacaggcgagttaacggcactatttttggtggcatctgtgagccatgtcagtgctttggtcatgcggagtcctgtgatgacgtcactggagaatgcctgaactgtaaggatcacacaggtggcccatattgtgataaatgtcttcctggtttctatggcgagcctactaaaggaacctctgaagactgtcaaccctgtgcctgtccactcaatatcccatccaataactttagcccaacgtgccatttagaccggagtcttggattgatctgtgatggatgccctgtcgggtacacaggaccacgctgtgagaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagccctgtcgctgtaatgccggtggctctttctctgaggtttgccacagtcaaactggacagtgtgagtgcagagccaacgttcagggtcagagatgtgacaaatgcaaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacagcttgtgaatgttctcatctgggtaataattgtgacccaaagactgggcgatgcatttgcccacccaataccattggagagaaatgttctaaatgtgcacccaatacctggggccacagcattaccactggttgtaaggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagagaaagaatggaaatattatggggatgatcctcgagtccatagaactgtgacccgagaagacttcttggatatactatatgatattcattacattcttatcaaagctacttatggaaatttcatgcgacaaagcaggatttctgaaatctcaatggaggtagctgaacaaggacgtggaacaacaatgactcctccagctgacttgattgaaaaatgtgattgtcccctgggctattctggcctgtcctgtgaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccagaattgtcaacatcacactgctggtgacttctgtgaacgatgtgctcttggatactatggaattgtcaagggattgccaaatgactgtcagcaatgtgcctgccctctgatttcttccagtaacaatttcagcccctcttgtgtcgcagaaggacttgacgactaccgctgcacggcttgtccacggggatatgaaggccagtactgtgaaaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgttttttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaagcacttgctgtcacctcagcgggccccagagaggcttattcagctggcagagggcaatctgaatacactcgtgaccgaaatgaacgagctgctgaccagggctaccaaagtgacagcagatggcgagcagaccggacaggatgctgagaggaccaacacaagagcaaagtccctgggagaattcattaaggagcttgcccgggatgcagaagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggagaaaaagaaggaggctgttgagagcggcaaacgacaaattgagaacactttaaaagaaggcaatgacatactcgatgaagccaaccgtcttgcagatgaaatcaactccatcatagactatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatggaatccttgatgaggctaaaaacatctccttcaatgccactgcagccttcaaagcttacagcaatattaaggactatattgatgaagctgagaaagttgccaaagaagccaaagatcttgcacatgaagctacaaaactggcaacaggtcctcggggtttattaaaggaagatgccaaaggctgtcttcagaaaagcttcaggattcttaacgaagccaagaagttagcaaatgatgtaaaagaaaatgaagaccatctaaatggcttaaaaaccaggatagaaaatgctgatgctagaaatggggatctcttgagaactttgaatgacactttgggaaagttatcagctattccaaatgatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacaaaatcattgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttattgactttctggctatagaaatgcgtaaaggcaaagtcagcttcctctgggatgttggatctggagttggacgtgtagagtacccagatttgactattgatgactcatattggtaccgtatcgtagcatcaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaagaaggctgatgctgtacgtgtgattacattcactggctgcatgggagaaacatactttgacaacaaacctataggtttgtggaatttccgagaaaaagaaggtgactgcaaaggatgcactgtcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctgagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaagccaatatatcaattgtagatatagatactaatcaggaggagaatatagcaacttcgtcttctggaaacaactttggtcttgacttgaaagcagatgacaaaatatattttggtggcctgccaacgctgagaaacttgagtatgaaagcaaggccagaagtaaatctgaagaaatattccggctgcctcaaagatattgaaatttcaagaactccgtacaatatactcagtagtcccgattatgttggtgttaccaaaggatgttccctggagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggcctattatgtaatactcctcaacaggggccgtctggaagtgcatctctccacaggggcacgaacaatgaggaaaattgtcatcagaccagagccgaatctgtttcatgatggaagagaacattccgttcatgtagagcgaactagaggcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgcagaatcagaaccagctcttttgatagggagcaagcagttcgggctttcaagaaacagtcacattgcaattgcatttgatgacaccaaagttaaaaaccgtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcagttggtggattcaaagtgggattggaccttcttgtagaatttgaattccgcacaactacaacgactggagttcttctggggatcagtagtcaaaaaatggatggaatgggtattgaaatgattgatgaaaagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcgtgtttttctaacacttagcttctacccatatatgtggattaaatggttctgggcatgcagggaggcttcgttaggaactcagctggagataattggttctcgaccggtaagtttaaccccagttcgttctcccgtgcataaagtttgttttgctattttcattttgtattgtttaaaaa

SEQ ID NO: 301481 - DNA, 1491 bp, Homo sapiens
actccacccaatatagtaaacatttcattaataattacatcaatagagtttacaaacttttcacctatttacttgcatttttaatctttcttcttaagacttcatttcttttcttttaccttgtcgaatgtcttgccaaactgactaatgtttttagtgtttcaatatgtttcgtttcttcaccagcttcaaaagaattctgtcatctcaaatttcaggggcttttccacattactaaaaacagatttttctcatttagaccagaacttctagtctaagttcttcattgttaggaatttaactggccttctggctcaggtctttggcacctgtgacatgaaacgggctccaaaatgtaatttatgtaactctcaatcttgtatataaaatgaaatccatgaaggaaaaaaatataattaaaacatcaaaagtttaaaatttaaaaaatcctttactttgaatttgtaaaccaaattaatgagtcactttaaacaatatcttttaagaaaattttataaggttcagtcagaactctcacattctaaaaagacgtgaggtagaatttttccctgtgtacactaggtccttttcttgtcacctggcctcaaatttttctgaaagcagaattattaccagctttacgtatcttgcctattaactcccaacaatgccccaaagcaaagagcataatttgtggctcctggtgattagatttatactttaatttgtcaagttttaaaatttttttcaatatgcccagttacatccatttcaaatgattctggctgatgtctttcctagagacctgatcatttgtatgtgtgaaccatcatgatacttctttaatgaaaccatctgtgactgttctatttcctactttccagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaatattaaactgattatttcattctaaaaaaaaaaaag

SEQ ID NO: 301482 - DNA, 9665 bp, Homo sapiens
cagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggcatagtaccaattctgtgtcaggcattttattcactttgtttcaactgttcttgagatcccggaggattaggactattgcagttataagtctataactgaggaaaggaagcttatctggacaggaagatatttagagtatgatataaagacagtctctttttaaaaacagcattttaaagtgagatgaacccggtacctcagatggaaaagcagaaatcacctgtcttctgcgtcgctcacgctgggagctgtagaccggagctgttcctattcggccatcttggctcctcccctaaaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccagagacacccgattacaaatgctattgatggaaagaacacttggtggcagagtcccagtattaagaatggaatcgaataccattatgtgacaattacactggatttacagcaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagatattactactcggtcaaggatatttcagttggagggatgtgcatctgctatggtcatgccagggcttgtccacttgatccagcgacaaataaatctcgctgtgagtgtgagcataacacatgtggcgatagctgtgatcagtgctgtccaggattccatcagaaaccctggagagctggaacttttctaactaaaactgaatgtgaagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtacagatggcttcttcagacccaaaggggtatctccaaattatccaaggccatgccagccatgtcattgcgatccaattggttccttaaatgaagtctgtgtcaaggatgagaaacatgctcgacgaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaaatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaactcccagcagtaggaggacagttgacatttaccatatcatatgaccttgaagaagaggaagaagatacagaacgtgttctccagcttatgattatcttagagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggttgagctctgttaaccttgaatccgctgtctcctatcctactgatggaagcattgcagcagctgtagaagtgtgtcagtgcccaccagggtatactggctcctcttgtgaatcttgttggcctaggcacaggcgagttaacggcactatttttggtggcatctgtgagccatgtcagtgctttggtcatgcggagtcctgtgatgacgtcactggagaatgcctgaactgtaaggatcacacaggtggcccatattgtgataaatgtcttcctggtttctatggcgagcctactaaaggaacctctgaagactgtcaaccctgtgcctgtccactcaatatcccatccaataactttagcccaacgtgccatttagaccggagtcttggattgatctgtgatggatgccctgtcgggtacacaggaccacgctgtgagaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagccctgtcgctgtaatgccggtggctctttctctgaggtttgccacagtcaaactggacagtgtgagtgcagagccaacgttcagggtcagagatgtgacaaatgcaaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacagcttgtgaatgttctcatctgggtaataattgtgacccaaagactgggcgatgcatttgcccacccaataccattggagagaaatgttctaaatgtgcacccaatacctggggccacagcattaccactggttgtaaggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagagaaagaatggaaatattatggggatgatcctcgagtccatagaactgtgacccgagaagacttcttggatatactatatgatattcattacattcttatcaaagctacttatggaaatttcatgcgacaaagcaggatttctgaaatctcaatggaggtagctgaacaaggacgtggaacaacaatgactcctccagctgacttgattgaaaaatgtgattgtcccctgggctattctggcctgtcctgtgaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccagaattgtcaacatcacactgctggtgacttctgtgaacgatgtgctcttggatactatggaattgtcaagggattgccaaatgactgtcagcaatgtgcctgccctctgatttcttccagtaacaatttcagcccctcttgtgtcgcagaaggacttgacgactaccgctgcacggcttgtccacggggatatgaaggccagtactgtgaaaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgttttttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaagcacttgctgtcacctcagcgggccccagagaggcttattcagctggcagagggcaatctgaatacactcgtgaccgaaatgaacgagctgctgaccagggctaccaaagtgacagcagatggcgagcagaccggacaggatgctgagaggaccaacacaagagcaaagtccctgggagaattcattaaggagcttgcccgggatgcagaagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggagaaaaagaaggaggctgttgagagcggcaaacgacaaattgagaacactttaaaagaaggcaatgacatactcgatgaagccaaccgtcttgcagatgaaatcaactccatcatagactatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatggaatccttgatgaggctaaaaacatctccttcaatgccactgcagccttcaaagcttacagcaatattaaggactatattgatgaagctgagaaagttgccaaagaagccaaagatcttgcacatgaagctacaaaactggcaacaggtcctcggggtttattaaaggaagatgccaaaggctgtcttcagaaaagcttcaggattcttaacgaagccaagaagttagcaaatgatgtaaaagaaaatgaagaccatctaaatggcttaaaaaccaggatagaaaatgctgatgctagaaatggggatctcttgagaactttgaatgacactttgggaaagttatcagctattccaaatgatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacaaaatcattgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttattgactttctggctatagaaatgcgtaaaggcaaagtcagcttcctctgggatgttggatctggagttggacgtgtagagtacccagatttgactattgatgactcatattggtaccgtatcgtagcatcaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaagaaggctgatgctgtacgtgtgattacattcactggctgcatgggagaaacatactttgacaacaaacctataggtttgtggaatttccgagaaaaagaaggtgactgcaaaggatgcactgtcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctgagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaagccaatatatcaattgtagatatagatactaatcaggaggagaatatagcaacttcgtcttctggaaacaactttggtcttgacttgaaagcagatgacaaaatatattttggtggcctgccaacgctgagaaacttgagtatgaaagcaaggccagaagtaaatctgaagaaatattccggctgcctcaaagatattgaaatttcaagaactccgtacaatatactcagtagtcccgattatgttggtgttaccaaaggatgttccctggagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggcctattatgtaatactcctcaacaggggccgtctggaagtgcatctctccacaggggcacgaacaatgaggaaaattgtcatcagaccagagccgaatctgtttcatgatggaagagaacattccgttcatgtagagcgaactagaggcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgcagaatcagaaccagctcttttgatagggagcaagcagttcgggctttcaagaaacagtcacattgcaattgcatttgatgacaccaaagttaaaaaccgtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcagttggtggattcaaagtgggattggaccttcttgtagaatttgaattccgcacaactacaacgactggagttcttctggggctggggttccagggcatttgtgtgatggacaatggcataaagtcactgccaacaagatcaaacaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaatattaaactgattatttcattctaaaaaaaaaaaag

SEQ ID NO: 301483 - DNA, 9520 bp, Homo sapiens
cagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggcatagtaccaattctgtgtcaggcattttattcactttgtttcaactgttcttgagatcccggaggattaggactattgcagttataagtctataactgaggaaaggaagcttatctggacaggaagatatttagagtatgatataaagacagtctctttttaaaaacagcattttaaagtgagatgaacccggtacctcagatggaaaagcagaaatcacctgtcttctgcgtcgctcacgctgggagctgtagaccggagctgttcctattcggccatcttggctcctcccctaaaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccagagacacccgattacaaatgctattgatggaaagaacacttggtggcagagtcccagtattaagaatggaatcgaataccattatgtgacaattacactggatttacagcaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagatattactactcggtcaaggatatttcagttggagggatgtgcatctgctatggtcatgccagggcttgtccacttgatccagcgacaaataaatctcgctgtgagtgtgagcataacacatgtggcgatagctgtgatcagtgctgtccaggattccatcagaaaccctggagagctggaacttttctaactaaaactgaatgtgaagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtacagatggcttcttcagacccaaaggggtatctccaaattatccaaggccatgccagccatgtcattgcgatccaattggttccttaaatgaagtctgtgtcaaggatgagaaacatgctcgacgaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaaatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaactcccagcagtaggaggacagttgacatttaccatatcatatgaccttgaagaagaggaagaagatacagaacgtgttctccagcttatgattatcttagagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggttgagctctgttaaccttgaatccgctgtctcctatcctactgatggaagcattgcagcagctgtagaagtgtgtcagtgcccaccagggtatactggctcctcttgtgaatcttgttggcctaggcacaggcgagttaacggcactatttttggtggcatctgtgagccatgtcagtgctttggtcatgcggagtcctgtgatgacgtcactggagaatgcctgaactgtaaggatcacacaggtggcccatattgtgataaatgtcttcctggtttctatggcgagcctactaaaggaacctctgaagactgtcaaccctgtgcctgtccactcaatatcccatccaataactttagcccaacgtgccatttagaccggagtcttggattgatctgtgatggatgccctgtcgggtacacaggaccacgctgtgagaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagccctgtcgctgtaatgccggtggctctttctctgaggtttgccacagtcaaactggacagtgtgagtgcagagccaacgttcagggtcagagatgtgacaaatgcaaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacagcttgtgaatgttctcatctgggtaataattgtgacccaaagactgggcgatgcatttgcccacccaataccattggagagaaatgttctaaatgtgcacccaatacctggggccacagcattaccactggttgtaaggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagagaaagaatggaaatattatggggatgatcctcgagtccatagaactgtgacccgagaagacttcttggatatactatatgatattcattacattcttatcaaagctacttatggaaatttcatgcgacaaagcaggatttctgaaatctcaatggaggtagctgaacaaggacgtggaacaacaatgactcctccagctgacttgattgaaaaatgtgattgtcccctgggctattctggcctgtcctgtgaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccagaattgtcaacatcacactgctggtgacttctgtgaacgatgtgctcttggatactatggaattgtcaagggattgccaaatgactgtcagcaatgtgcctgccctctgatttcttccagtaacaatttcagcccctcttgtgtcgcagaaggacttgacgactaccgctgcacggcttgtccacggggatatgaaggccagtactgtgaaaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgttttttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaagcacttgctgtcacctcagcgggccccagagaggcttattcagctggcagagggcaatctgaatacactcgtgaccgaaatgaacgagctgctgaccagggctaccaaagtgacagcagatggcgagcagaccggacaggatgctgagaggaccaacacaagagcaaagtccctgggagaattcattaaggagcttgcccgggatgcagaagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggagaaaaagaaggaggctgttgagagcggcaaacgacaaattgagaacactttaaaagaaggcaatgacatactcgatgaagccaaccgtcttgcagatgaaatcaactccatcatagactatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatggaatccttgatgaggctaaaaacatctccttcaatgccactgcagccttcaaagcttacagcaatattaaggactatattgatgaagctgagaaagttgccaaagaagccaaagatcttgcacatgaagctacaaaactggcaacaggtcctcggggtttattaaaggaagatgccaaaggctgtcttcagaaaagcttcaggattcttaacgaagccaagaagttagcaaatgatgtaaaagaaaatgaagaccatctaaatggcttaaaaaccaggatagaaaatgctgatgctagaaatggggatctcttgagaactttgaatgacactttgggaaagttatcagctattccaaatgatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacaaaatcattgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttattgactttctggctatagaaatgcgtaaaggcaaagtcagcttcctctgggatgttggatctggagttggacgtgtagagtacccagatttgactattgatgactcatattggtaccgtatcgtagcatcaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaagaaggctgatgctgtacgtgtgattacattcactggctgcatgggagaaacatactttgacaacaaacctataggtttgtggaatttccgagaaaaagaaggtgactgcaaaggatgcactgtcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctgagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaagccaatatatcaattgtagatatagatactaatcaggaggagaatatagcaacttcgtcttctggaaacaactttggtcttgacttgaaagcagatgacaaaatatattttggtggcctgccaacgctgagaaacttgagtatgaaagcaaggccagaagtaaatctgaagaaatattccggctgcctcaaagatattgaaatttcaagaactccgtacaatatactcagtagtcccgattatgttggtgttaccaaaggatgttccctggagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggcctattatgtaatactcctcaacaggggccgtctggaagtgcatctctccacaggggcacgaacaatgaggaaaattgtcatcagaccagagccgaatctgtttcatgatggaagagaacattccgttcatgtagagcgaactagaggcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgcagaatcagaaccagctcttttgatagggagcaagcagttcgggctttcaagaaacagtcacattgcaattgcatttgatgacaccaaagttaaaaaccgtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcagttggtggattcaaagtgggattggaccttcttgtagaatttgaattccgcacaactacaacgactggagttcttctggggccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaatattaaactgattatttcattctaaaaaaaaaaaag

SEQ ID NO: 301484 - DNA, 7910 bp, Homo sapiens
cagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggcatagtaccaattctgtgtcaggcattttattcactttgtttcaactgttcttgagatcccggaggattaggactattgcagttataagtctataactgaggaaaggaagcttatctggacaggaagatatttagagtatgatataaagacagtctctttttaaaaacagcattttaaagtgagatgaacccggtacctcagatggaaaagcagaaatcacctgtcttctgcgtcgctcacgctgggagctgtagaccggagctgttcctattcggccatcttggctcctcccctaaaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccagagacacccgattacaaatgctattgatggaaagaacacttggtggcagagtcccagtattaagaatggaatcgaataccattatgtgacaattacactggatttacagcaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagatattactactcggtcaaggatatttcagttggagggatgtgcatctgctatggtcatgccagggcttgtccacttgatccagcgacaaataaatctcgctgtgagtgtgagcataacacatgtggcgatagctgtgatcagtgctgtccaggattccatcagaaaccctggagagctggaacttttctaactaaaactgaatgtgaagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtacagatggcttcttcagacccaaaggggtatctccaaattatccaaggccatgccagccatgtcattgcgatccaattggttccttaaatgaagtctgtgtcaaggatgagaaacatgctcgacgaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaaatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaactcccagcagtaggaggacagttgacatttaccatatcatatgaccttgaagaagaggaagaagatacagaacgtgttctccagcttatgattatcttagagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggttgagctctgttaaccttgaatccgctgtctcctatcctactgatggaagcattgcagcagctgtagaagtgtgtcagtgcccaccagggtatactggctcctcttgtgaatcttgttggcctaggcacaggcgagttaacggcactatttttggtggcatctgtgagccatgtcagtgctttggtcatgcggagtcctgtgatgacgtcactggagaatgcctgaactgtaaggatcacacaggtggcccatattgtgataaatgtcttcctggtttctatggcgagcctactaaaggaacctctgaagactgtcaaccctgtgcctgtccactcaatatcccatccaataactttagcccaacgtgccatttagaccggagtcttggattgatctgtgatggatgccctgtcgggtacacaggaccacgctgtgagaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagccctgtcgctgtaatgccggtggctctttctctgaggtttgccacagtcaaactggacagtgtgagtgcagagccaacgttcagggtcagagatgtgacaaatgcaaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacagcttgtgaatgttctcatctgggtaataattgtgacccaaagactgggcgatgcatttgcccacccaataccattggagagaaatgttctaaatgtgcacccaatacctggggccacagcattaccactggttgtaaggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagagaaagaatggaaatattatggggatgatcctcgagtccatagaactgtgacccgagaagacttcttggatatactatatgatattcattacattcttatcaaagctacttatggaaatttcatgcgacaaagcaggatttctgaaatctcaatggaggtagctgaacaaggacgtggaacaacaatgactcctccagctgacttgattgaaaaatgtgattgtcccctgggctattctggcctgtcctgtgaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccagaattgtcaacatcacactgctggtgacttctgtgaacgatgtgctcttggatactatggaattgtcaagggattgccaaatgactgtcagcaatgtgcctgccctctgatttcttccagtaacaatttcagcccctcttgtgtcgcagaaggacttgacgactaccgctgcacggcttgtccacggggatatgaaggccagtactgtgaaaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgttttttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaagcacttgctgtcacctcagcgggccccagagaggcttattcagctggcagagggcaatctgaatacactcgtgaccgaaatgaacgagctgctgaccagggctaccaaagtgacagcagatggcgagcagaccggacaggatgctgagaggaccaacacaagagcaaagtccctgggagaattcattaaggagcttgcccgggatgcagaagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggagaaaaagaaggaggctgttgagagcggcaaacgacaaattgagaacactttaaaagaaggcaatgacatactcgatgaagccaaccgtcttgcagatgaaatcaactccatcatagactatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatggaatccttgatgaggctaaaaacatctccttcaatgccactgcagccttcaaagcttacagcaatattaaggactatattgatgaagctgagaaagttgccaaagaagccaaagatcttgcacatgaagctacaaaactggcaacaggtcctcggggtttattaaaggaagatgccaaaggctgtcttcagaaaagcttcaggattcttaacgaagccaagaagttagcaaatgatgtaaaagaaaatgaagaccatctaaatggcttaaaaaccaggatagaaaatgctgatgctagaaatggggatctcttgagaactttgaatgacactttgggaaagttatcagctattccaaatgatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacaaaatcattgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttattgactttctggctatagaaatgcgtaaaggcaaagtcagcttcctctgggatgttggatctggagttggacgtgtagagtacccagatttgactattgatgactcatattggtaccgtatcgtagcatcaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaagaaggctgatgctgtacgtgtgattacattcactggctgcatgggagaaacatactttgacaacaaacctataggtttgtggaatttccgagaaaaagaaggtgactgcaaaggatgcactgtcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctgagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaagcaacaggaatggacctggaggtcattatcctaagtgacataacccagaaacagaaaatccaataccatatgttctcacttacaaggcgagaagctaaacaatggatacacgaagacgtgaagatggaaacaatagacactggggactccaaaaggggggagggaggagaaggggtgaagatttaaaaatcgcctgttgggtacagtgttcactgtgtgggtgatgggtccactagaagcccaaacttcactcttatgcaat

SEQ ID NO: 301485 - DNA, 187 bp, Homo sapiens
gatcttgcacatgaagctacaaaactggtaagaaacaaatggcacatgtgctgggaatggaagtcaacctttttgaatttttcaaatgtaagtcagtctggaaaatcccagtaaattggtatatttgttttgggttatttttgaagacctcttttaaaatttgcctaaaataaattctcggtatgct

SEQ ID NO: 301486 - DNA, 596 bp, Homo sapiens
cagctatgcaggggaggagggaaacaatgaggatcttcaacttagactgagaaaagcacactaatggacttaaaaaggcatgcggggattgggcttaattgtaaggaagcaaaaaaacgaaaataaaaaaatcttatttattacattctattagccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatgtaagtgtttatattatccccattgctttctaatttttacccagtattctgagtcatttcagaaggaagattattcaggatatctagtacactctgatattagaattgaaagaaatataacctatctaaacctattcttacatcttcattgaatgacttacctatatttccatcttcaattttgtttacaaaacagtacattttcagttgaaatgttggaaaacacagaaatatccagaatcatgaataaaagacacttataataccatgaca

SEQ ID NO: 301487 - DNA, 214 bp, Homo sapiens
actgaggtccccccaaaggctcactgatgaaatttcttgccttaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgct

SEQ ID NO: 301488 - DNA, 593 bp, Homo sapiens
gcacgagaaatgtttgtggtttggttttttttgtttttaatttccaaaagtggacacgaccaggaacatgaaagagaaaagcagctgatagatattttttaaaaattaatgatgactgtgtgttttctctaagatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaagtaagtccacgcttgcttcccgctattctgctttaactgactgatcgtgagaatgggttttagttggtaattcttttaaagaaagacaaaatcaaatacacactgaattggattgccagaaccagctaaatcacattgagttgggcgtttcttccatgttgcacaagaccttaaagagccacggcatccttaatatgcaactttgtatagctgatgttctatgtaaactttttgaatgggcaaataaattaatgaagccgctagtgtattttcgtaaagcaaatta

SEQ ID NO: 301489 - DNA, 1054 bp, Homo sapiens
atagccggacctgctgctgactatttgttgcttaaatgatgagagacatataatctccaccctcacggagttgtcatcaccctggagaggaagaagacagccaaaagagagaagtattgtcttgtagacttactagattcacatagtatcatccttctccagtgtgtaaggtgttgtctaaataggtccagttaaagaactacagggtagccatttttaaaaaaaaattttggccacgttttcaaattcacaggggagggggaatgtctcatactccagccctcctgagcctaggccctctgtgagatgtgtcaccatttcttggacaccatatgagacattccccctcggattagagatgctcaacctgcatcaacaaatctaaagcctgcatctggctaccctggggcgagtcctgtttacagtgcctattcctggagctcgcctctttttgccttttgtttgattatgtgatgtattacttttcccagcaggccagtgctagcatactggaagagggatttaataagctggcacccttgatgctatgctcctaatccaaccttatttgcctcattggccatttccattatggtggcagccctccattccagccacagcagcccctcagcgtcccccagtcacactgtccccattgctgctcatctgtgcctttgtccatctacaatgcccttatttcactctgcctgtgggagtcctgtgaatctctccaaagccaactcagttcatctttctgcttgaaaccttccctgaataggccaggtgcggtggctcacgcctgtaatcccagcactttgggaggccaaggcaggcggatcacaaggtcaggagatcgagaccatcctggctaacacagaccattctctactaaaaatgcaaaaaattagctgggtgtggtggcgggcgtgtgtcgtcccagctacttgtgaggctgaagcaggaaaatggcatgaacctgggaggtggagcatgcagccagccaagatcgggccgctgcactccagcctgggggacagagcgagactctgcctca

SEQ ID NO: 301490 - DNA, 3644 bp, Homo sapiens
agctgtggtcgtcatggaccggaagcgtgtgcggcgcgcctgccttgaggccagcatcagggaagggtgtcccaggtgcaggcgaagcttccttcaggtgctcctggaggacttttggctcgcaagcgcttctccattctcccaacgtctcgggcctgatgttatcatctccctatccttggctgcacctgaaaagagcaggagccggcaggtaacccgatcgcctcccccaggaggtgaagtgaaatctgcaagagtcctgctcgttcaaggcctgcatacaggaaagaagcaggggaaaagcgttagaaacagcttttgttctacagcattttaaaatataataggtatattgaaaagtctgattcagttacaatcagtgtatggaatcacaagaagatccataagaaacaaggtgctggatttctccgttgtgttcgtctttttccagtgccatcaaccacctcaaagacactggttatcagaggttggatttatgcaaacttgggccaaaggacagttagaagacagtagctgaagaagcatctgtagggaatccagaaggagcattcatgaagatgttacaagcccggaagcagcacatgagcactgagctgactattgagtcggaggcgccctcagacagcagtggcatcaacttgtcaggctttgggagtgagcagctagacaccaatgacgagagtgatgttagcagcgcactaagttacatcttgccttatctctcactgagaaatctaggtgcagaatcaatattgttaccgttcactgaacagctattttcaaatgtacaagatggagataggctcctgagtattttgaaaaacaatagaaagagcccctcacagtccagccttctaggtaacaaatttaaaaacaaaatatttgaaaaaaaaattagaaactgcgcaaccacaggaaaaccgcctggcaaagattcaaagtgtaggcaaaaacctgcagagagtgaacagagtcctcatgggcccaaggagcatccaggaaaggcacttcaaaaaggtgggaaagcacagcactaggaaagaacaggatgcccaggcatttgtggacaatgctgccaaaggaaaaaggcttgagggtccagccccaagggagctggaacagcctcacatagtgcaggggcctgagaaggtagtgggaaacaccatctacaccaagccttcattcacccaagagcataaggcagcagtctcctctgtgctgaaacccttctccatgggcgtgccttctgcctctagccctgcaaaagccctacctcaggtcagagacagatcgaaagacttagcctacaccattttaattttagaaatggcaatggctagagtgaaaaacatgaaggctgctaaaccaatcacacattccagaaaaaaatagcgcttttataaaactcactccattgtggcccacagaacacccaaggccaaaaagattagaaagtttagaaagggcagttatctcaacagaccgatgctcgcaaagaggccgctgttctctgcagcaaagagcctcatacattcgcaagggattttttcatccttaggagacctgagtcctcaagaaaaccctcttctggaagtagttgctccttcagaacgttttacagaaaacactaatgtaaaagacacaactaatgtaaaagacacaaaagagatgtgttcaaagacacatctctgaaaacacaaactacaatcatcctcctgaggcagtttccgctgggactgcattcaacttagaaccaactgttaaacaaactgagacaaaatgggaatacaacaatgtgggcattgacttgtcccctgagcccaaaagcttcaattacccattgctctcgtccccaggtgatcagcttgaaattcagctaaccgagcagctacggtccctcatccccaacgaggatgtgagaaagttcatgtctcatgttatctggaccttgaaaatggaatgttcagaaacacatgtgcaagggagctgtgccaagctcatgtcgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggatatgactataagaacaaactcatcttcgcaatatctgtgactgtcatactaataattttgattataattttttgttttatagaggtaaagacaataattaattcaggttttcaaaatacaatcctgtgtttgtgtggattcagaatccacaaactgaaaaccaacgtcactttcccacttgacattcttcttctgtcatttaaggctgaggtgtgctttgttcttttactgcaatgtatattccaggattgttaaaggatcctcgcttccaggaggtctctgtgaaataaaaccaagttaatcccactagactattttaagaagttaagttgatataatagcaaaatttctcccacccaaaactatgtcaacaattggatgtactcactgagtcaccccttactctgccactaatttatttccttgttgcttaaatgatgagagacatataatctccaccctcacggagttgtcatcaccctggagaggaagaagacagccaaaagagagaagtattgtcttgtagacttactagattcacatagtatcatccttctccagtgtgtaaggtgttgtctaaataggtccagttaaagaactacagggtagccatttttaaaaaaaaattttggccacgttttcaaattcacaggggagggggaatgtctcatactccagccctcctgagcctaggccctctgtgagatgtgtcaccatttcttggacaccatatgagacattccccctcggattagagatgctcaacctgcatcaacaaatctaaagcctgcatctggctaccctggggcgagtcctgtttacagtgcctattcctggagctcgcctctttttgccttttgtttgattatgtgatgtattacttttcccagcaggccagtgctagcatactggaagagggatttaataagctggcacccttgatgctatgctcctaatccaaccttatttgcctcattggccatttccattatggtggcagccctccattccagccacagcagcccctcagcgtcccccagtcacactgtccccattgctgctcatctgtgcctttgtccatctacaatgcccttatttcactctgcctgtgggagtcctgtgaatctctccaaagccaactcagttcatctttctgcttgaaaccttccctgaataggccaggtgcggtggctcacgcctgtaatcccagcactttgggaggccaaggcaggcggatcacaaggtcaggagatcgagaccatcctggctaacacagaccattctctactaaaaatgcaaaaaattagctgggtgtggtggcgggcgtgtgtcgtcccagctacttgtgaggctgaagcaggaaaatggcatgaacctgggaggtggagcatgcagccagccaagatcgggccgctgcactccagcctgggggacagagcgagactctgcctca

SEQ ID NO: 301491 - DNA, 3729 bp, Homo sapiens
agctgtggtcgtcatggaccggaagcgtgtgcggcgcgcctgccttgaggccagcatcagggaagggtgtcccaggtgcaggcgaagcttccttcaggtgctcctggaggacttttggctcgcaagcgcttctccattctcccaacgtctcgggcctgatgttatcatctccctatccttggctgcacctgaaaagagcaggagccggcaggtaacccgatcgcctcccccaggaggtgaagtgaaatctgcaagagtcctgctcgttcaaggcctgcatacaggaaagaagcaggggaaaagcgttagaaacagcttttgttctacagcattttaaaatataataggtatattgaaaagtctgattcagttacaatcagtgtatggaatcacaagaagatccataagaaacaaggtgctggatttctccgttgtgttcgtctttttccagtgccatcaaccacctcaaagacactggttatcagaggttggatttatgcaaacttgggccaaaggacagttagaagacagtagtaagtcttcagtccagggaccaaatcggcacaggaggacaagttgtggactgcagtcatttatttgataatgatttaccagacaactgaagaagcatctgtagggaatccagaaggagcattcatgaagatgttacaagcccggaagcagcacatgagcactgagctgactattgagtcggaggcgccctcagacagcagtggcatcaacttgtcaggctttgggagtgagcagctagacaccaatgacgagagtgatgttagcagcgcactaagttacatcttgccttatctctcactgagaaatctaggtgcagaatcaatattgttaccgttcactgaacagctattttcaaatgtacaagatggagataggctcctgagtattttgaaaaacaatagaaagagcccctcacagtccagccttctaggtaacaaatttaaaaacaaaatatttgaaaaaaaaattagaaactgcgcaaccacaggaaaaccgcctggcaaagattcaaagtgtaggcaaaaacctgcagagagtgaacagagtcctcatgggcccaaggagcatccaggaaaggcacttcaaaaaggtgggaaagcacagcactaggaaagaacaggatgcccaggcatttgtggacaatgctgccaaaggaaaaaggcttgagggtccagccccaagggagctggaacagcctcacatagtgcaggggcctgagaaggtagtgggaaacaccatctacaccaagccttcattcacccaagagcataaggcagcagtctcctctgtgctgaaacccttctccatgggcgtgccttctgcctctagccctgcaaaagccctacctcaggtcagagacagatcgaaagacttagcctacaccattttaattttagaaatggcaatggctagagtgaaaaacatgaaggctgctaaaccaatcacacattccagaaaaaaatagcgcttttataaaactcactccattgtggcccacagaacacccaaggccaaaaagattagaaagtttagaaagggcagttatctcaacagaccgatgctcgcaaagaggccgctgttctctgcagcaaagagcctcatacattcgcaagggattttttcatccttaggagacctgagtcctcaagaaaaccctcttctggaagtagttgctccttcagaacgttttacagaaaacactaatgtaaaagacacaactaatgtaaaagacacaaaagagatgtgttcaaagacacatctctgaaaacacaaactacaatcatcctcctgaggcagtttccgctgggactgcattcaacttagaaccaactgttaaacaaactgagacaaaatgggaatacaacaatgtgggcattgacttgtcccctgagcccaaaagcttcaattacccattgctctcgtccccaggtgatcagcttgaaattcagctaaccgagcagctacggtccctcatccccaacgaggatgtgagaaagttcatgtctcatgttatctggaccttgaaaatggaatgttcagaaacacatgtgcaagggagctgtgccaagctcatgtcgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggatatgactataagaacaaactcatcttcgcaatatctgtgactgtcatactaataattttgattataattttttgttttatagaggtaaagacaataattaattcaggttttcaaaatacaatcctgtgtttgtgtggattcagaatccacaaactgaaaaccaacgtcactttcccacttgacattcttcttctgtcatttaaggctgaggtgtgctttgttcttttactgcaatgtatattccaggattgttaaaggatcctcgcttccaggaggtctctgtgaaataaaaccaagttaatcccactagactattttaagaagttaagttgatataatagcaaaatttctcccacccaaaactatgtcaacaattggatgtactcactgagtcaccccttactctgccactaatttatttccttgttgcttaaatgatgagagacatataatctccaccctcacggagttgtcatcaccctggagaggaagaagacagccaaaagagagaagtattgtcttgtagacttactagattcacatagtatcatccttctccagtgtgtaaggtgttgtctaaataggtccagttaaagaactacagggtagccatttttaaaaaaaaattttggccacgttttcaaattcacaggggagggggaatgtctcatactccagccctcctgagcctaggccctctgtgagatgtgtcaccatttcttggacaccatatgagacattccccctcggattagagatgctcaacctgcatcaacaaatctaaagcctgcatctggctaccctggggcgagtcctgtttacagtgcctattcctggagctcgcctctttttgccttttgtttgattatgtgatgtattacttttcccagcaggccagtgctagcatactggaagagggatttaataagctggcacccttgatgctatgctcctaatccaaccttatttgcctcattggccatttccattatggtggcagccctccattccagccacagcagcccctcagcgtcccccagtcacactgtccccattgctgctcatctgtgcctttgtccatctacaatgcccttatttcactctgcctgtgggagtcctgtgaatctctccaaagccaactcagttcatctttctgcttgaaaccttccctgaataggccaggtgcggtggctcacgcctgtaatcccagcactttgggaggccaaggcaggcggatcacaaggtcaggagatcgagaccatcctggctaacacagaccattctctactaaaaatgcaaaaaattagctgggtgtggtggcgggcgtgtgtcgtcccagctacttgtgaggctgaagcaggaaaatggcatgaacctgggaggtggagcatgcagccagccaagatcgggccgctgcactccagcctgggggacagagcgagactctgcctca

SEQ ID NO: 301492 - DNA, 2731 bp, Homo sapiens
agctgtggtcgtcatggaccggaagcgtgtgcggcgcgcctgccttgaggccagcatcagggaagggtgtcccaggtgcaggcgaagcttccttcaggtgctcctggaggacttttggctcgcaagcgcttctccattctcccaacgtctcgggcctgatgttatcatctccctatccttggctgcacctgaaaagagcaggagccggcaggtaacccgatcgcctcccccaggaggtgaagtgaaatctgcaagagtcctgctcgttcaaggcctgcatacaggaaagaagcaggggaaaagcgttagaaacagcttttgttctacagcattttaaaatataataggtatattgaaaagtctgattcagttacaatcagtgtatggaatcacaagaagatccataagaaacaaggtgctggatttctccgttgtgttcgtctttttccagtgccatcaaccacctcaaagacactggttatcagaggttggatttatgcaaacttgggccaaaggacagttagaagacagtagtaagtcttcagtccagggaccaaatcggcacaggaggacaagttgtggactgcagtcatttatttgataatgatttaccagacaactgaagaagcatctgtagggaatccagaaggagcattcatgaagatgttacaagcccggaagcagcacatgagcactgagctgactattgagtcggaggcgccctcagacagcagtggcatcaacttgtcaggctttgggagtgagcagctagacaccaatgacgagagtgatgttagcagcgcactaagttacatcttgccttatctctcactgagaaatctaggtgcagaatcaatattgttaccgttcactgaacagctattttcaaatgtacaagatggagataggctcctgagtattttgaaaaacaatagaaagagcccctcacagtccagccttctaggtgatcagcttgaaattcagctaaccgagcagctacggtccctcatccccaacgaggatgtgagaaagttcatgtctcatgttatctggaccttgaaaatggaatgttcagaaacacatgtgcaagggagctgtgccaagctcatgtcgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggatatgactataagaacaaactcatcttcgcaatatctgtgactgtcatactaataattttgattataattttttgttttatagaggtaaagacaataattaattcaggttttcaaaatacaatcctgtgtttgtgtggattcagaatccacaaactgaaaaccaacgtcactttcccacttgacattcttcttctgtcatttaaggctgaggtgtgctttgttcttttactgcaatgtatattccaggattgttaaaggatcctcgcttccaggaggtctctgtgaaataaaaccaagttaatcccactagactattttaagaagttaagttgatataatagcaaaatttctcccacccaaaactatgtcaacaattggatgtactcactgagtcaccccttactctgccactaatttatttccttgttgcttaaatgatgagagacatataatctccaccctcacggagttgtcatcaccctggagaggaagaagacagccaaaagagagaagtattgtcttgtagacttactagattcacatagtatcatccttctccagtgtgtaaggtgttgtctaaataggtccagttaaagaactacagggtagccatttttaaaaaaaaattttggccacgttttcaaattcacaggggagggggaatgtctcatactccagccctcctgagcctaggccctctgtgagatgtgtcaccatttcttggacaccatatgagacattccccctcggattagagatgctcaacctgcatcaacaaatctaaagcctgcatctggctaccctggggcgagtcctgtttacagtgcctattcctggagctcgcctctttttgccttttgtttgattatgtgatgtattacttttcccagcaggccagtgctagcatactggaagagggatttaataagctggcacccttgatgctatgctcctaatccaaccttatttgcctcattggccatttccattatggtggcagccctccattccagccacagcagcccctcagcgtcccccagtcacactgtccccattgctgctcatctgtgcctttgtccatctacaatgcccttatttcactctgcctgtgggagtcctgtgaatctctccaaagccaactcagttcatctttctgcttgaaaccttccctgaataggccaggtgcggtggctcacgcctgtaatcccagcactttgggaggccaaggcaggcggatcacaaggtcaggagatcgagaccatcctggctaacacagaccattctctactaaaaatgcaaaaaattagctgggtgtggtggcgggcgtgtgtcgtcccagctacttgtgaggctgaagcaggaaaatggcatgaacctgggaggtggagcatgcagccagccaagatcgggccgctgcactccagcctgggggacagagcgagactctgcctca

SEQ ID NO: 301493 - DNA, 2115 bp, Homo sapiens
gcagccattttcatttttaggtatattgaaaagtctgattcagttacaatcagtgtatggaatcacaagaagatccataagaaacaaggtgctggatttctccgttgtgttcgtctttttccagtgccatcaaccacctcaaagacactggttatcagaggttggatttatgcaaacttgggccaaaggacagttagaagacagtagctgaagaagcatctgtagggaatccagaaggagcattcatgaagatgttacaagcccggaagcagcacatgagcactgagctgactattgagtcggaggcgccctcagacagcagtggcatcaacttgtcaggctttgggagtgatcagcttgaaattcagctaaccgagcagctacggtccctcatccccaacgaggatgtgagaaagttcatgtctcatgttatctggaccttgaaaatggaatgttcagaaacacatgtgcaagggagctgtgccaagctcatgtcgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggatatgactataagaacaaactcatcttcgcaatatctgtgactgtcatactaataattttgattataattttttgttttatagaggtaaagacaataattaattcaggttttcaaaatacaatcctgtgtttgtgtggattcagaatccacaaactgaaaaccaacgtcactttcccacttgacattcttcttctgtcatttaaggctgaggtgtgctttgttcttttactgcaatgtatattccaggattgttaaaggatcctcgcttccaggaggtctctgtgaaataaaaccaagttaatcccactagactattttaagaagttaagttgatataatagcaaaatttctcccacccaaaactatgtcaacaattggatgtactcactgagtcaccccttactctgccactaatttatttccttgttgcttaaatgatgagagacatataatctccaccctcacggagttgtcatcaccctggagaggaagaagacagccaaaagagagaagtattgtcttgtagacttactagattcacatagtatcatccttctccagtgtgtaaggtgttgtctaaataggtccagttaaagaactacagggtagccatttttaaaaaaaaattttggccacgttttcaaattcacaggggagggggaatgtctcatactccagccctcctgagcctaggccctctgtgagatgtgtcaccatttcttggacaccatatgagacattccccctcggattagagatgctcaacctgcatcaacaaatctaaagcctgcatctggctaccctggggcgagtcctgtttacagtgcctattcctggagctcgcctctttttgccttttgtttgattatgtgatgtattacttttcccagcaggccagtgctagcatactggaagagggatttaataagctggcacccttgatgctatgctcctaatccaaccttatttgcctcattggccatttccattatggtggcagccctccattccagccacagcagcccctcagcgtcccccagtcacactgtccccattgctgctcatctgtgcctttgtccatctacaatgcccttatttcactctgcctgtgggagtcctgtgaatctctccaaagccaactcagttcatctttctgcttgaaaccttccctgaataggccaggtgcggtggctcacgcctgtaatcccagcactttgggaggccaaggcaggcggatcacaaggtcaggagatcgagaccatcctggctaacacagaccattctctactaaaaatgcaaaaaattagctgggtgtggtggcgggcgtgtgtcgtcccagctacttgtgaggctgaagcaggaaaatggcatgaacctgggaggtggagcatgcagccagccaagatcgggccgctgcactccagcctgggggacagagcgagactctgcctca

SEQ ID NO: 301494 - DNA, 2611 bp, Homo sapiens
agctgtggtcgtcatggaccggaagcgtgtgcggcgcgcctgccttgaggccagcatcagggaagggtgtcccaggtgcaggcgaagcttccttcaggtgctcctggaggacttttggctcgcaagcgcttctccattctcccaacgtctcgggcctgatgttatcatctccctatccttggctgcacctgaaaagagcaggagccggcaggtaacccgatcgcctcccccaggaggtgaagtgaaatctgcaagagtcctgctcgttcaaggcctgcatacaggaaagaagcaggggaaaagcgttagaaacagcttttgttctacagcattttaaaatataataggtatattgaaaagtctgattcagttacaatcagtgtatggaatcacaagaagatccataagaaacaaggtgctggatttctccgttgtgttcgtctttttccagtgccatcaaccacctcaaagacactggttatcagaggttggatttatgcaaacttgggccaaaggacagttagaagacagtagtaagtcttcagtccagggaccaaatcggcacaggaggacaagttgtggactgcagtcatttatttgataatgatttaccagacaactgaagaagcatctgtagggaatccagaaggagcattcatgaagatgttacaagcccggaagcagcacatgagcactgagctgactattgagtcggaggcgccctcagacagcagtggcatcaacttgtcaggctttgggagtgagcagctagacaccaatgacgagagtgatgttagcagcgcactaagttacatcttgccttatctctcactgagaaatctaggtgatcagcttgaaattcagctaaccgagcagctacggtccctcatccccaacgaggatgtgagaaagttcatgtctcatgttatctggaccttgaaaatggaatgttcagaaacacatgtgcaagggagctgtgccaagctcatgtcgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggatatgactataagaacaaactcatcttcgcaatatctgtgactgtcatactaataattttgattataattttttgttttatagaggtaaagacaataattaattcaggttttcaaaatacaatcctgtgtttgtgtggattcagaatccacaaactgaaaaccaacgtcactttcccacttgacattcttcttctgtcatttaaggctgaggtgtgctttgttcttttactgcaatgtatattccaggattgttaaaggatcctcgcttccaggaggtctctgtgaaataaaaccaagttaatcccactagactattttaagaagttaagttgatataatagcaaaatttctcccacccaaaactatgtcaacaattggatgtactcactgagtcaccccttactctgccactaatttatttccttgttgcttaaatgatgagagacatataatctccaccctcacggagttgtcatcaccctggagaggaagaagacagccaaaagagagaagtattgtcttgtagacttactagattcacatagtatcatccttctccagtgtgtaaggtgttgtctaaataggtccagttaaagaactacagggtagccatttttaaaaaaaaattttggccacgttttcaaattcacaggggagggggaatgtctcatactccagccctcctgagcctaggccctctgtgagatgtgtcaccatttcttggacaccatatgagacattccccctcggattagagatgctcaacctgcatcaacaaatctaaagcctgcatctggctaccctggggcgagtcctgtttacagtgcctattcctggagctcgcctctttttgccttttgtttgattatgtgatgtattacttttcccagcaggccagtgctagcatactggaagagggatttaataagctggcacccttgatgctatgctcctaatccaaccttatttgcctcattggccatttccattatggtggcagccctccattccagccacagcagcccctcagcgtcccccagtcacactgtccccattgctgctcatctgtgcctttgtccatctacaatgcccttatttcactctgcctgtgggagtcctgtgaatctctccaaagccaactcagttcatctttctgcttgaaaccttccctgaataggccaggtgcggtggctcacgcctgtaatcccagcactttgggaggccaaggcaggcggatcacaaggtcaggagatcgagaccatcctggctaacacagaccattctctactaaaaatgcaaaaaattagctgggtgtggtggcgggcgtgtgtcgtcccagctacttgtgaggctgaagcaggaaaatggcatgaacctgggaggtggagcatgcagccagccaagatcgggccgctgcactccagcctgggggacagagcgagactctgcctca

SEQ ID NO: 301495 - DNA, 2008 bp, Homo sapiens
ggctatctagaggatccctatcagccccttcatgccacttcctacttcctagcccttttatcaactcctagcaatagttaaatgagagacacatctagatgggatgaaagcactcgatatgttcatgtccagggccttcatgccatgcccaacacacctctccctgggcctcctggctctctccctcaggtcttaacctggaggaccccccacgagcacagtcctggctttggtagggagcgcaggggcatgaaagcactcgacatgaattcatgtcggtccctcatccccaacgaggatgtgagaaagttcatgtctcatgttatctggaccttgaaaatggaatgttcagaaacacatgtgcaagggagctgtgccaagctcatgtcgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggatatgactataagaacaaactcatcttcgcaatatctgtgactgtcatactaataattttgattataattttttgttttatagaggtaaagacaataattaattcaggttttcaaaatacaatcctgtgtttgtgtggattcagaatccacaaactgaaaaccaacgtcactttcccacttgacattcttcttctgtcatttaaggctgaggtgtgctttgttcttttactgcaatgtatattccaggattgttaaaggatcctcgcttccaggaggtctctgtgaaataaaaccaagttaatcccactagactattttaagaagttaagttgatataatagcaaaatttctcccacccaaaactatgtcaacaattggatgtactcactgagtcaccccttactctgccactaatttatttccttgttgcttaaatgatgagagacatataatctccaccctcacggagttgtcatcaccctggagaggaagaagacagccaaaagagagaagtattgtcttgtagacttactagattcacatagtatcatccttctccagtgtgtaaggtgttgtctaaataggtccagttaaagaactacagggtagccatttttaaaaaaaaattttggccacgttttcaaattcacaggggagggggaatgtctcatactccagccctcctgagcctaggccctctgtgagatgtgtcaccatttcttggacaccatatgagacattccccctcggattagagatgctcaacctgcatcaacaaatctaaagcctgcatctggctaccctggggcgagtcctgtttacagtgcctattcctggagctcgcctctttttgccttttgtttgattatgtgatgtattacttttcccagcaggccagtgctagcatactggaagagggatttaataagctggcacccttgatgctatgctcctaatccaaccttatttgcctcattggccatttccattatggtggcagccctccattccagccacagcagcccctcagcgtcccccagtcacactgtccccattgctgctcatctgtgcctttgtccatctacaatgcccttatttcactctgcctgtgggagtcctgtgaatctctccaaagccaactcagttcatctttctgcttgaaaccttccctgaataggccaggtgcggtggctcacgcctgtaatcccagcactttgggaggccaaggcaggcggatcacaaggtcaggagatcgagaccatcctggctaacacagaccattctctactaaaaatgcaaaaaattagctgggtgtggtggcgggcgtgtgtcgtcccagctacttgtgaggctgaagcaggaaaatggcatgaacctgggaggtggagcatgcagccagccaagatcgggccgctgcactccagcctgggggacagagcgagactctgcctca

SEQ ID NO: 301496 - DNA, 2759 bp, Homo sapiens
  misc_feature (1700)..(1700): n is a, c, g, or t
  misc_feature (1904)..(1904): n is a, c, g, or t
  misc_feature (1923)..(1923): n is a, c, g, or t
  misc_feature (2069)..(2069): n is a, c, g, or t
  misc_feature (2075)..(2075): n is a, c, g, or t
agctgtggtcgtcatggaccggaagcgtgtgcggcgcgcctgccttgaggccagcatcagggaagggtgtcccaggtgcaggcgaagcttccttcaggtgctcctggaggacttttggctcgcaagcgcttctccattctcccaacgtctcgggcctgatgttatcatctccctatccttggctgcacctgaaaagagcaggagccggcaggtaacccgatcgcctcccccaggaggtgaagtgaaatctgcaagagtcctgctcgttcaaggcctgcatacaggaaagaagcaggggaaaagcgttagaaacagcttttgttctacagcattttaaaatataataggtatattgaaaagtctgattcagttacaatcagtgtatggaatcacaagaagatccataagaaacaaggtgctggatttctccgttgtgttcgtctttttccagtgccatcaaccacctcaaagacactggttatcagaggttggatttatgcaaacttgggccaaaggacagttagaagacagtaggtgccgtgctgggcagtgaatgaatgaaccttgccctggggttaacactccagtgggatgaacagacaaaccccacaagcactgcatacgatgagaaaagttggagctggagaaagaccgtgttcctcgtgttctgtgagacctgggaaggctgctaaaacccagggagcaggagttctcctccctccatccttatccacagtctgggtcccatccagaccctcctctccaaaccgggggtttgcgacaaagcaggtgagggaggcatttcattccagagcagaagaaggggtttcctcccccatcccactcccgtttcatttttaaggggaaaagcagctccccatacggtgaggcaatgaggcggaccagcaggttcccggggatctctgcagccccgttgccataacaaccgaactcactcgcagcctctgataggggagtcagctgggaccacagcttgggcaggaaagggatgagggagtaggaaagaaacttcaagatcaaccactggccctcacaccgagctgcgcacaccccaaggccaagggaggctggaaacccttgtcatccttgggaaatgggggagggcactggtacccctgggacctccctcctgaatctgggcagctttaaacattttttttccaactttggaagacagttgtacaacctcgaaggagaggaggtgtcacgattcacaaagcgtatggatcacacatggctctaggggacattctctttgctctgttttattttgagatagggtcttgctctattgcccaggctggagtccagtggcatgatcacaccttactgcagcctcaaattactggactgaggtgatcctcctgcctcagccatgtgagtagctgggactacagacatgcaccaccacacctggctaatttttaaaatatatatgtttttgtagagatagggtcctgctacattgcccaggctggtctcaaactcctggcttcaagtgatcctcctgctttggcctcccaaagtgttgggattataggcatgagccactgcatccagcatcatttcttttcattattattatgattattattttgagatggagtctcgctctgtcacccaggctgtagtggagtggtgtgacctcagctcactgcaacctccacctcccgggttcnagtgattctcctgcctcagcctcctgaggaggtgcgattacaggtaccctccacaatgcctggctaatttttttttctttttgagacggagtcttcctctgtctcccaggctggagtgcaatggcgcgatctcagctcactggaacctctgcttcccaggttcaagcaattcttctgcctcagcttcctgagtagctgggactncaggcaggcgcccaccacncctgactaatttttgtatttttagtagagacggggtttcaccatattggctggtctcaaactcctgaccttataatccgcccacctcggcctccaaagtgctgggattacaggcgtaagccaccgtccctggcctaacctggctantttttntatttttagtagagacggggcttcaccatgttggcaaggcaagtctcgaacttatgacctcaagtgatctgctcaccttggcctcccaaagtgctgggattacaggcgtgagccactgcacccagcctaattttttttttttttttaatgaagacagggtctcactacattacccaggctggtctcgagctcctggcctcaagcgatcctcccatctcagcctcctgagtagcttggattacaggcacaagccatcatgactggcttcctcttttttttttttttaatgaatatggtaaagtgcacaaatcataaatttcagcgtggtgaatttctacacatgtatacccatgtatccaccatgcagaccagaagaacatatttgtccctccaggaaattcccaaatgctctttctcagtcaatatcctccaatttgacattttcatcatagattagttttgcctacccctgaactttgtgtaagtggaaatacatggtttggcatcttgcttttatgcaacattgtatctgtgagaatctattgtcatgtctgttttcctgttctttttctttgttgtataatattccattgtggagatgtatcacaatgtatttatcttactgctgatagatatttgagttgtttgcagtgaatggttattgtagataaagcagctatgaac

SEQ ID NO: 301497 - DNA, 2820 bp, Homo sapiens
agctgtggtcgtcatggaccggaagcgtgtgcggcgcgcctgccttgaggccagcatcagggaagggtgtcccaggtgcaggcgaagcttccttcaggtgctcctggaggacttttggctcgcaagcgcttctccattctcccaacgtctcgggcctgatgttatcatctccctatccttggctgcacctgaaaagagcaggagccggcaggtaacccgatcgcctcccccaggaggtgaagtgaaatctgcaagagtcctgctcgttcaaggcctgcatacaggaaagaagcaggggaaaagcgttagaaacagcttttgttctacagcattttaaaatataataggtatattgaaaagtctgattcagttacaatcagtgtatggaatcacaagaagatccataagaaacaaggtgctggatttctccgttgtgttcgtctttttccagtgccatcaaccacctcaaagacactggttatcagaggttggatttatgcaaacttgggccaaaggacagttagaagacagtagctgaagaagcatctgtagggaatccagaaggagcattcatgaagatgttacaagcccggaagcagcacatgagcactgagctgactattgagtcggaggcgccctcagacagcagtggcatcaacttgtcaggctttgggagtgagcagctagacaccaatgacgagagtgatgttagcagcgcactaagttacatcttgccttatctctcactgagaaatctaggtgcagaatcaatattgttaccgttcactgaacagctattttcaaatgtacaagatggagataggctcctgagtattttgaaaaacaatagaaagagcccctcacagtccagccttctaggtaacaaatttaaaaacaaaatatttgaaaaaaaaattagaaactgcgcaaccacaggaaaaccgcctggcaaagattcaaagtgtaggcaaaaacctgcagagagtgaacagagtcctcatgggcccaaggagcatccaggaaaggcacttcaaaaaggtgggaaagcacagcactaggaaagaacaggatgcccaggcatttgtggacaatgctgccaaaggaaaaaggcttgagggtccagccccaagggagctggaacagcctcacatagtgcaggggcctgagaaggtagtgggaaacaccatctacaccaagccttcattcacccaagagcataaggcagcagtctcctctgtgctgaaacccttctccatgggcgtgccttctgcctctagccctgcaaaagccctacctcaggtcagagacagatcgaaagacttagcctacaccattttaattttagaaatggcaatggctagagtgaaaaacatgaaggctgctaaaccaatcacacattccagaaaaaaatagcgcttttataaaactcactccattgtggcccacagaacacccaaggccaaaaagattagaaagtttagaaagggcagttatctcaacagaccgatgctcgcaaagaggccgctgttctctgcagcaaagagcctcatacattcgcaagggattttttcatccttaggagacctgagtcctcaagaaaaccctcttctggaagtagttgctccttcagaacgttttacagaaaacactaatgtaaaagacacaactaatgtaaaagacacaaaagagatgtgttcaaagacacatctctgaaaacacaaactacaatcatcctcctgaggcagtttccgctgggactgcattcaacttagaaccaactgttaaacaaactgagacaaaatgggaatacaacaatgtgggcattgacttgtcccctgagcccaaaagcttcaattacccattgctctcgtccccaggtgatcagcttgaaattcagctaaccgagcagctacggtccctcatccccaacgaggatgtgagaaagttcatgtctcatgttatctggaccttgaaaatggaatgttcagaaacacatgtgcaagggagctgtgccaagctcatgtcgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggatatgactataagaacaaactcatcttcgcaatatctgtgactgtcatactaataattttgattataattttttgttttatagaggtaaagacaataattaattcaggttttcaaaatacaatcctgtgtttgtgtggattcagaatccacaaactgaaaaccaacgtcactttcccacttgacattcttcttctgtcatttaaggctgaggtgtgctttgttcttttactgcaatgtatattccaggattgttaaaggatcctcgcttccaggaggtctctgtgaaataaaaccaagttaatcccactaaaaaaaaaaaaaaaaaaaaaaaaaaaaaaaaaaaaattgggggggggcctgcggacctccaggagaaaaagtttctctaacacacccatcggctcggggcggggcgggggcaccccagatgggtcagtcgcgacaaagtggggccacaacgcggctggctcccaagaaaaaacccggggcccacgacacgggcgggcgggttcctcccaccattaaaaaagccgccgcgggacacgagaccggtcggcaaccaatcccaaagaggggtcggagggccagagggccctctccaaagggggctccaggagccgaataatgca

SEQ ID NO: 301498 - DNA, 848 bp, Homo sapiens
ccgatgctcgcaaagaggccgctgttctctgcagcaaagagcctcatacattcgcaagggattttttcatccttaggagacctgagtcctcaagaaaaccctcttctggaagtagttgctccttcagaacgttttacagaaaacactaatgtaaaagacacaactaatgtaaaagacacaaaagagatgtgttcaaagacacatctctgaaaacacaaactacaatcatcctcctgaggcagtttccgctgggactgcattcaacttagaaccaactgttaaacaaactgagacaaaatgggaatacaacaatgtgggcattgacttgtcccctgagcccaaaagcttcaattacccattgctctcgtccccaggtgatcagcttgaaattcagctaaccgagcagctacggtccctcatccccaacgaggatgtgagaaagttcatgtctcatgttatctggaccttgaaaatggaatgttcagaaacacatgtgcaagggagctgtgccaagctcatgtcgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgaggtgaggagcacacagaaacatgagacccagatttcccatcatttagcatatgccaggaaagtgcccacataggagaacctgggactcccaggccatagcttgtcttggccatgtaactttggccatgacagtgatctcccactttgctcatgtagacagtgaaatagattagggcacaaga

SEQ ID NO: 301499 - DNA, 786 bp, Homo sapiens
cttactctgtgtgactggggcatacagctatggactgagtatgaaagatgatcaaagatatttcatgatcaaagcagtctcttcttttctgacagctgaagaagcatctgtagggaatccagaaggagcattcatgaagatgttacaagcccggaagcagcacatgagcactgagctgactattgagtcggaggcgccctcagacagcagtggcatcaacttgtcaggctttgggagtgagcagctagacaccaatgacgagagtgatgttagcagcgcactaagttacatcttgccttatctctcactgagaaatctaggtgcagaatcaatattgttaccgttcactgaacagctattttcaaatgtacaagatggagataggctcctgagtattttgaaaaacaatagaaagagcccctcacagtccagccttctaggtaacaaatttaaaaacaaaatatttgaaaaaaaaattagaaactgcgcaaccacaggaaaaccgcctggcaaagattcaaagtgtaggcaaaaacctgcagagagtgaacagagtcctcatgggcccaaggagcatccaggaaaggcacttcaaaaaggtgggaaagcacagcactaggaaagaacaggatgcccaggcatttgtggacaatgctgccaaaggaaaaaggcttgagggtccagccccaagggagctggaacagcctcacatagtgcaggggcctgagaaggtagtgggaaacaccatctacaccaagccttcattcacccaagagcataaggcag

SEQ ID NO: 301500 - DNA, 413 bp, Homo sapiens
atttaattagcaatactttagactaaaactttgacctcttaatgtcattgaaatagagctaggattctactgacatcattatgttattatattatctttttgcatgagttgatgccatgttactaattggctgtgatagagcctttacgtacttgcaggtatatccacagacaagtacagtaatgcttctccctgcactgcttgtctgcaggaggtgaagtgaaatctgcaagagtcctgctcgttcaaggcctgcatacaggaaagaagcaggggaaaagcgttagaaacagcttttgttctacagcattttaaaatataataggtaggtcaaatttttggtctgtcagccttgacactatcccttgaaagtaggtcatgtcattgaaatgtatttaaaatgtgactgtgat

SEQ ID NO: 301501 - DNA, 2155 bp, Homo sapiens
gccgctcagagaaaatacaagcccgttttccctagctgtgccatttggtgctctgccaggctgccgtgcaagggaataccgacgagacgagctgcactgtctctgatttggagccctcaccggagcttgtctttaaaaatgagcaggaagctcatgtatgtttgcatttcagtgagccgggtcctgacctgccgccacccatcacggtcagcgtggtgcatcttaccgaggaggcgcaggcctggattcttttgagtggtgctactgcctaggaagtaacacgtggagaatttccatcttgggaccatgcacacagtgccttggggagtagattttgccctaatagcgatgaagaattttatcagtcagtggagttcctttttcagatcagggatgggaaagagccaaactgggtacctcccacgtgtgccccgtgaacagccctttgcagctgggctgtggggcttggctgctgccctgtcccatctggcagttaacgccttctccctgctctgccccccactccccaaaaccagttgcagcctcaacccacatggggatgtagaaagccgtaaagtccacgctactgttgaaaatgtttacatctccgctctcaacctgccttgggttcgtgttaaatggtgttaaattctgcaaatggaggggaaaaaaatcaaattctaaatttcaaagtagaatttaaagcaaatttgtaaaaaaattatcctaccaccccttttggtccacttaagatatgccacgctgaagcaaggtatttcctactggattttgctttcactggtgtttagaaaataaacttgatttctctaggagcactcctttggttagagggatgcaagaaggagaggtgaaggtggcgtgtggtggctcatgcctgtaatcccagcactttggggaggccgaggcaggcggatcacttgaggccagcagtttgagaccagcctggccaacatgatgaaaccccatctctactaaaaatacaaaaaattagctgggcatggtggcaggcacctgtaatcccagttacttgggaggctgaggcaggagaattgcttgaacccaggaggtggaggttgcagtgagctgagattgtgccactgcacttcagcctgggcgacagagtgactctgtcaaaaaggaaaggcaaaaaccggaccctggagctctgtgggccctgattgcaggcccctccctgtgtgatgagggatgagtcagcttggggagccacttggccagcctgcatgcctggtcatcaggaggttgagaaaagccttgaaagttgtgaagcactgagcagatacaagtgtttgttaattttgtagaaattaactttcccatctggcctttatctccaaagttggtattgttgctccacgcagactgcagtccggtttcttattgtgactttgacaatgcaaagtgcaaaataggaagaggcctccccaccccactatcccaccctggtgaccaattcagtgtaaccattgcacgtactcagtcattggtgtctttggagtgacatctgcagccagttagtgccacctgagtacagcactcgtacttttacatgatgtgtgtgtgagtagctcttctgtccaaaccatgatttgaggttcaactacctgtagatcaaagctttattttagaacgataaactgattttttccaaatgggtgaaatcttctccccatgactatgttttcttaactttgcattgaatctatttactgggttacattctatgtgtagtttgctttcttcatttttttttcttttaaaatgctcatgtcttattccaagcaccttcctccaaagtccccataaagctgcatctccaacacattgttatgccaataaggttttatttaactttatttaaggatgattgtgtctttgaatgacaaatgtactgctgcttcctacctgcaagacgcacaatgtatgtttcaagggtgagcaagtgttatttcttaaatttctcaaatgcctgtagtaactattgtttctgcctctcaattgttgccagctctttgaagaaggggagaattgtgtgtttttgtgtggggatgtttctgatatgctgctacagttgcaaaacactggagctagagaaaataaagtactgatcttcgaa

SEQ ID NO: 301502 - DNA, 482 bp, Homo sapiens
tgaggaggaacaagaggccccatatctgaatgaccgttcccgaggaggcgggccctgcaagcagcagtgccgagactgggttacattctatgtgtagtttgctttcttcatttttttttcttttaaaatgctcatgtcttattccaagcaccttcctccaaagtccccataaagctgcatctccaacacattgttatgccaataaggttttatttaactttatttaaggatgattgtgtctttgaatgacaaatgtactgctgcttcctacctgcaagacgcacaatgtatgtttcaagggtgagcaagtgttatttcttaaatttctcaaatgcctgtagtaactattgtttctgcctctcaattgttgccagctctttgaagaaggggagaattgtgtgtttttgtgtggggatgtttctgatatgctgctacagttgcaaaacactggagctagagaaaataaagtactgatcttcgaa

SEQ ID NO: 301503 - DNA, 1753 bp, Homo sapiens
gtaactgaaatagcacgaaaagtaaccttgtgtgactttataaccttattaaacattttgcccatttgcctctggagtcaagatcttaatctcattcagaagactgagtggacaaggatttggtatgcatagatggaggcactggcaaccggagaggtcccagggctgcataacactaagtagctcatagtgactcaacattggaacttggtataacttgtctatgattaaagccattccagtgataccacagtgatatagtggtaccacaaagtagttttagttttgtttcactgaaaaataatgaatgtcagcatcttttcatatgattaatgaacagagtatcttcttttgtgaaatacctgttcaagtgttttgcctgtttttctactgtgttgtctaccttttccttattgatatgcgagatttcctgtcttgttgaatataaaatgtatacacagctttcttcctccttctctgtccacgtagtcatgcccgattcctctttgccttctggcatgattgttcaagatggtggataggagacagggctgacctgcagctcttaacttggatggacagaacagcatgtggagactcacactgtggacttcttgctccaggaaccaccacaggagtgtactagaaaaactgaaagaattcacagatgctttgaaagaagcagcaggctgctgcaaattctgtgagaccggcagaaatctctggtgctctctcaaaactgccaccttctggctggaggccaaccacaatattacagcaactcatgacagaatagccctgcttcaaggtaggagaaaacaatagctaattccactgcctgcaacatcctgggcaaccagtggtcctgagtctctccatgtgacaacactgctagcataaccagcatctgagaaagccagcacactaaacatatctacatccaaggactctcacagagtctacttcactcccgtaccatctccaccagaacaggtgctggtatccacagctgggagacctgaagacagattgtatcacaggactctatgcagacatttgcaagtaccagctcagagtctggtagccccacggggtggttaggcccagtagagcaataacaatcactgcagtgtggcttgctggaagccccatccctaacggggagtgcatcacatcaagggaccaccaacgtggtacaaaagaatctgaacaacagcccttgagttccagatttttccactgaaatagtctacccaaatgagaaggaatcagaaaagtaattctggtaatatgacaaggtaataaaacaaggttctataacatccccaaaagaccacactagctccccagcaatgggtccaaatcaagaagaagtctctgaattgcgaaataaataactcagaaggttgattattaagctactcagggagataccagggaaaggtgaaaaccaacttaaagaaattaaaaaaaaatacaagatatggatgaaaaatgctccagaagatatttactccagagaagtaaatatcgtagagataatgtttattctagagaataaataaatattgtattccagagaaataaatatcataaagaaaaaaagaatcacaacttctggaaatgaaaaacacacttagagaaatgcagtatgcactggaattcccacaatagactagaacaaatagaagaaagaacttcagagctcaaagataaggcttacaaattaacccaatcagacaaagacagagca

SEQ ID NO: 301504 - DNA, 1699 bp, Homo sapiens
gtaactgaaatagcacgaaaagtaaccttgtgtgactttataaccttattaaacattttgcccatttgcctctggagtcaagatcttaatctcattcagaagactgagtggacaaggatttggtatgcatagatggaggcactggcaaccggagaggtcccagggctgcataacactaagtagctcatagtgactcaacattggaacttggtataacttgtctatgattaaagccattccagtgataccacagtgatatagtggtaccacaaagtagttttagttttgtttcactgaaaaataatgaatgtcagcatcttttcatatgattaatgaacagagtatcttcttttgtgaaatacctgttcaagtgttttgcctgtttttctactgtgttgtctaccttttccttattgatatgcgagatttcctgtcttgttgaatataaaatgtatacacagctttcttcctccttctctgtccacgtagtcatgcccgattcctctttgccttctggcatgattgttcaagatggtggataggagacagggctgacctgcagctcttaacttggatggacagaacagcatgtggagactcacactgtggacttcttgctccaggaaccaccacaggagtgtactagaaaaactgaaagaattcacagatgctttgaaagaagcagcaggctgctgcaaattctgtgagaccggcagaaatctctggtgctctctcaaaactgccaccttctggctggaggccaaccacaatattacagcaactcatgacagaatagccctgcttcaaggtaggagatctctccatgtgacaacactgctagcataaccagcatctgagaaagccagcacactaaacatatctacatccaaggactctcacagagtctacttcactcccgtaccatctccaccagaacaggtgctggtatccacagctgggagacctgaagacagattgtatcacaggactctatgcagacatttgcaagtaccagctcagagtctggtagccccacggggtggttaggcccagtagagcaataacaatcactgcagtgtggcttgctggaagccccatccctaacggggagtgcatcacatcaagggaccaccaacgtggtacaaaagaatctgaacaacagcccttgagttccagatttttccactgaaatagtctacccaaatgagaaggaatcagaaaagtaattctggtaatatgacaaggtaataaaacaaggttctataacatccccaaaagaccacactagctccccagcaatgggtccaaatcaagaagaagtctctgaattgcgaaataaataactcagaaggttgattattaagctactcagggagataccagggaaaggtgaaaaccaacttaaagaaattaaaaaaaaatacaagatatggatgaaaaatgctccagaagatatttactccagagaagtaaatatcgtagagataatgtttattctagagaataaataaatattgtattccagagaaataaatatcataaagaaaaaaagaatcacaacttctggaaatgaaaaacacacttagagaaatgcagtatgcactggaattcccacaatagactagaacaaatagaagaaagaacttcagagctcaaagataaggcttacaaattaacccaatcagacaaagacagagca

SEQ ID NO: 301505 - DNA, 482 bp, Homo sapiens
ctcagcctcctgagtagctgggattacaggcacatgccaccacgtctagctaatttttgtacttttagtagagatggggtttcaccacgttggtcgaactcctgacctcaggcgatccacccgcgtcggcctcccaaagtgctgggattacaggcatgagccaccgtgcctagccaatttattttaaacccaaaaattggtgttattttaaaaccaaaaataggatcataatgtacacgttgtatgcagtttgcttttttaaaaactttgttttgtgaacatctttccaagtctgtcagcacatagacctaattgctcttggcagctgggtggtatttcatagtatgagtatacgatgattcattctcctatttatggacattttaattgtgttcagttgtttactattacagataacgctgcagtgaacattctctcacatgtctttatgcactcttgctagtgtttgtgtaagataaatt

SEQ ID NO: 301506 - DNA, 2564 bp, Homo sapiens
agatgtggtccctgccctcatggggctgacagtcctaaaatcaagtgctaggacacagtggccattgagctgggagcattcttccctctaccgcttaagccactgatggctgcgagcttgaagagagggattctgagggagagcttggtccatctggtcaccaaggctgggcgggacagagcagtcaagaaccacggtgtggcttgagaaacagtcctgcttcctgagcctctttgctctgcctcttggggcaagctccttaacctgtctgtatttttatgcctctgtctcccattcagttcctccttgaatacctctttctacagagaggcacgggctcccctgaaggattgtcgaggccagggttcgggaagtacactgccatcggtcaggggacagctgcctcccaccttgcctgggtgatggtgaatgggactcatcttttcctgccttgcttttgaggagatggttgaatttaagctaacaggaaagccaaaccagcaccctcctttgtgctctgagaggttggagacatctggtccaccccattgcccctgcccctggcaagccctgaagtcgggagaggtgaccacaggtctgaaaatcagccagtgccaacattgcttgccctgcaaggtgcaactgagcccacatagcgcattcatagtttccctgaccacagccttgggaagacggtggaaacccgaggatgtgtgggtttcccagctaacggacaagctcccctgccacacccagtgcccacgcatgctcacatacatacagcagaccacaaccctgttgccaagcagtgcttccaagggatagcgatccagattccaacattgtcttggagagggttagtccacatccaagttgcgtgagataagatgcaaagggctctgtgtggatgaggaacgcaccttagaggagtgggaaaggccaccagggttgggccctgtttaggtaattcctgttggcagcacctagagagagcatctgagctgaaggagtgggaaactttgcccaagcaatggcacgggcagcgggctctttctggcgccctgtgctggagcagggccaagtcttagggcatcacaaacagcccatttgatggagggagcagggacatagcacatttttgtctgtctttgtgaggctgctttgctaactctctgaggagaggaagcctctcgggctttccgtcggctggggctagtgccagagaatcccttctcagtggccagcaggttcctgggaggccggcacaaggcaccgctccccactcatgacaccttggtgcagagtgacctcctgcccagtcaccactccggccagccccagccaaacacacaaaagcccatggttgcggttgcatctacaccgttagttggcaaaggatcctgcttgagctctgcgtggtggccaaggagtagcatggaggagggccctgattttaaaaaggaaaaatagagaggcctcaaaacaatgaaacaaagagcttgatatgtcaagaggagaccaaggccctgggaggcataggcaagccgggcagagtcagaccagtgccctcccttgaccatctcctagcattccttaacctagacaggggctaccccatgtgagtccaagccagactttgtggctgtccccagcctgcacagcccaagcccagggaagtgtcctttctttcccttccttactaataatgggccttcctgagacacattcagagaaggatcagagagaaaggagaaccatccaggagagccacaagcgtccaccaaacagtgtctcaggcctcacctgaagctgctgttcctcctatcagcacactagtattaaatgggtgttccataatgaggagaatggaaataggtacaaggcatctagcttaggacagaatcggatttcggcatgtgaaggaatcccagagctgatctcattgaaatgatctatcgtacagacaaggatatgcaaatccacagaagtgaagggatttttgctcaagatcacatagctggtaaactaaggtaaggttagggcttgaacttgggccttctgactccttgtccagtcagtgttctttcatctcaccacagctgcctcctttgaaacagaggtattaagatctgtccttctggttcaccctctcatacctctttactgcctctcccacatcccccacatgcctcccaaaatgaaagacaaacaggattgtttctgagaccaagatcagtctgtctgtgatcagcctgtgtgtggttcacccagtcatgcaattaagggcagatctgggccagtggaataggatagctgattggtgtttgttactgtgaaccctagaccgtaccccgtagaatggtgtctcttgctttgtaacacatcgggccttcagtgtgctgtattcctcagaagtgagggcatctcggtccattctgcccatggccacagggtgcagagaggcagcagggcccatgcaagctgccaccctgggatttgctgggctggagttcaacagatgtaaagacttcagtgaagcaataaacacaaaactctgggagaag

SEQ ID NO: 301507 - DNA, 3272 bp, Homo sapiens
agatgtggtccctgccctcatggggctgacagtcctaaaatcaagtgctaggacacagtggccattgagctgggagcattcttccctctaccgcttaagccactgatggctgcgagcttgaagagagggattctgagggagagcttggtccatctggtcaccaaggctgggcgggacagagcagtcaagaaccacggtgtggcttgagaaacagtcctgcttcctgagcctctttgctctgcctcttggggcaagctccttaacctgtctgtatttttatgcctctgtctcccattcagttcctccttgaatacctctttctacagagaggcacgggctcccctgaaggattgtcgaggccagggttcgggaagtacactgccatcggtcaggggacagctgcctcccaccttgcctgggtgatggtgaatgggactcatcttttcctgccttgcttttgaggagatggttgaatttaagctaacaggaaagccaaaccagcaccctcctttgtgctctgagaggttggagacatctggtccaccccattgcccctgcccctggcaagccctgaagtcgggagaggtgaccacaggtctgaaaatcagccagtgccaacattgcttgccctgcaaggtgcaactgagcccacatagcgcattcatagtttccctgaccacagccttgggaagacggtggaaacccgaggatgtgtgggtttcccagctaacggacaagctcccctgccacacccagtgcccacgcatgctcacatacatacagcagaccacaaccctgttgccaagcagtgcttccaagggatagcgatccagattccaacattgtcttggagagggttagtccacatccaagttgcgtgagataagatgcaaagggctctgtgtggatgaggaacgcaccttagaggagtgggaaaggccaccagggttgggccctgtttaggtaattcctgttggcagcacctagagagagcatctgagctgaaggagtgggaaactttgcccaagcaatggcacgggcagcgggctctttctggcgccctgtgctggagcagggccaagtcttagggcatcacaaacagcccatttgatggagggagcagggacatagcacatttttgtctgtctttgtgaggctgctttgctaactctctgaggagaggaagcctctcgggctttccgtcggctggggctagtgccagagaatcccttctcagtggccagcaggttcctgggaggccggcacaaggcaccgctccccactcatgacaccttggtgcagagtgacctcctgcccagtcaccactccggccagccccagccaaacacacaaaagcccatggttgcggttgcatctacaccgttagttggcaaaggatcctgcttgagctctgcgtggtggccaaggagtagcatggaggagggccctgattttaaaaaggaaaaatagagaggcctcaaaacaatgaaacaaagagcttgatatgtcaagaggagaccaaggccctgggaggcataggcaagccgggcagagtcagaccagtgccctcccttgaccatctcctagcattccttaacctagacaggggctaccccatgtgagtccaagccagactttgtggctgtccccagcctgcacagcccaagcccagggaagtgtcctttctttcccttccttactaataatgggccttcctgagacacattcagagaaggatcagagagaaaggagaaccatccaggagagccacaagcgtccaccaaacagtgtctcaggcctcacctgaagctgctgttcctcctatcagcacactagtattaaatgggtgttccataatgaggagaatggaaataggtacaaggcatctagcttaggacagaatcggatttcggcatgtgaaggaatcccagagctgatctcattgaaatgatctatcgtacagacaaggatatgcaaatccacagaagtgaagggatttttgctcaagatcacatagctggtaaactaaggtaaggttagggcttgaacttgggccttctgactccttgtccagtcagtgttctttcatctcaccacagctgcctcctttgaaacagaggtattaagatctgtccttctggttcaccctctcatacctctttactgcctctcccacatcccccacatgcctcccaaaatgaaagacaaacaggattgtttctgagaccaagatcagtctgtctgtgatcagcctgtgtgtggttcacccagtcatgcaattaagggcagatctgggccagtggaataggatagctgattggtgtttgttactgtgaaccctagaccgtaccccgtagaatggtgtctcttgctttgtaacacatcgggccttcagtgtgctgtattcctcagaagtgagggcatctcggtccattctgcccatggccacagggtgcagagaggcagcagggcccatgcaagctgccaccctgggatttgctgggctggagttcaacagatgtaaagacttcagtgaagcaataaacacaaaactctgggagaagatatccagaattttgtacattactctgtttctttttcaaaaatgaggcagatcagatgcccctgagctgcccctttttttctgattcccaactgcaatgtcctcagtcagtgttgtccctctgcccggctccccagctctttgccaacctcttcacactccccttgagctgagcatcagtcgcctgtgacgtggccaccttctgtcctgctcccactcccgacccatgctggaccccggaggacctcctgccccgcccccaccacacacccatatcccccaccattccaatttgttctttcccgtggggaattttttttcccagcgtctccatcccttcgtacatatccacacacacacaaattggtctgatcttttttccattggttaaacatttaactccatgccagaccttgttttaacccctctcacatcatgttctttccttttttgcgagttattttgcattaaccaactttgtcagtgacagatgcgtatctgagggtgtcacacacgaccttcagcagggaagacttctgggccatggagggccgtctaatacatggacttataaactgactgcatgagcaatgaaaaggccaaattattctgaattttttttgaatcactgtaaaaaaactgatttcttttgtatagagaacactaaacgtataataaaagttgttcaaaatggactcttgccatgtga

SEQ ID NO: 301508 - DNA, 1857 bp, Homo sapiens
gtctgtggcaaaattactgtaattcaaattggaaaaaaaaatgtttccagactttgtccaacatttattcctatggcaaaggaaattactatgtaatactaattatttcttatgctggtatgttttaagctactctatgaagtatgtgaaacatcaatatttatggattaatagatggcctgatgtctttcaaatgggagaggagtaaattttagtgttaccaactcatgacacttgtaatacaataaatcttaaaatttttattttccacttacaggtatactttactaaataattaccttaaatggcagtgcatattaggattttttagcacatactactaaaattatatagtaacttttaacttgtgctgatatttcccaaccaaaaaagacatcattcacttcatcataaccaaaataagtagtactgtaatatttatcttcatttatttagacatgattaagataccgtaagactcctctaatttacctggaatttttagccattgattcaaggacttgaatgctgtttacttggtactacctaatgaaaggatttggtaataaaggttataatcacgattttaaagaaaaatgtttcatcttgaaggcaaatttttaagctttttatttagaggtgtttacttaagaatagtaatttaaaagcattcttatttgtcattaagacaagtacccaaaagaattgtaataagtaatacttggccaatgcaaatttgtacatttgaaatcatacacttgaaagaaaaaaatgaaggcttgtgagtgcttaaactgcatatctttttaaaaattcaaattttagacatatcagtttaaattatccttaataaggttttactatgtcagtgatgtatattacaaaatgtctacctatgttatgttaatgatatctctatactgcatcatattcggcatggttatggtatattttgtacttttgattgtggactattgataggattgatatagcaataaatctgattcagacttaatattttttaaaacgctagataccatactgtatcataatcctattatatttgacttgaatgcccaaaattttcatagttctatattttatgttaaaaatttagtattacatgttagggatttatttttgtctgctattttcacatacattcttttagaactgagtctgtttctatttagatcatagacgtctaaagaagtattattaattcatgaactgctttgtggaaaaatttaaataaagtatgaaatgactagattaccccaaattgtttatttttttttttggttaatgaccaggttacaattctcagacaaatgaaattggcttgataactgattgaatatagtagataatggaaagtttgactctttaagggcttccaagtgttaaatacattctcaattctgaattacttcatagtaactacttaaataatggtaagccaattctcctttttctttttgagatatttaacacaatttgcgtcttctgatcccattcccttcttccccaaaaaccatgctagaatttaaaattggaagagtttaatttgtcatctacattttagtttttttattctatagataagtaagaagacaagtagacgttctgctgtcaagacagtccatgttattgttggccattcttttcagggataatgcttaatgttatttgtgcgttgtataaggaatgttgtttatcagtatatagacctaccattagtagaaatgatgtatggcaggctttcttgaataatatgtattgtaagtttgtttcctatagtgttattatggttcagattcttttaaataaagctagtttttaaagagaaaaaaaact

SEQ ID NO: 301509 - DNA, 1863 bp, Homo sapiens
gtctgtggcaaaattactgtaattcaaattggaaaaaaaaatgtttccagactttgtccaacatttattcctatggcaaaggaaattactatgtaatactaattatttcttatgctggtatgttttaagctactctatgaagtatgtgaaacatcaatatttatggattaatagatggcctgatgtctttcaaatgggagaggagtaaattttagtgttaccaactcatgacacttgtaatacaataaatcttaaaatttttattttccacttacaggtatactttactaaataattaccttaaatggcagtgcatattaggattttttagcacatactactaaaattatatagtaacttttaacttgtgctgatatttcccaaccaaaaaagacatcattcacttcatcataaccaaaataagtagtactgtaatatttatcttcatttatttagacatgattaagataccgtaagactcctctaatttacctggaatttttagccattgattcaaggacttgaatgctgtttacttggtactacctaatgaaaggatttggtaataaaggttataatcacgattttaaagaaaaatgtttcatcttgaaggcaaatttttaagctttttatttagaggtgtttacttaagaatagtaatttaaaagcattcttatttgtcattaagacaagtacccaaaagaattgtaataagtaatacttggccaatgcaaatttgtacatttgaaatcatacacttgaaagaaaaaaatgaaggcttgtgagtgcttaaactgcatatctttttaaaaattcaaattttagacatatcagtttaaattatccttaataaggttttactatgtcagtgatgtatattacaaaatgtctacctatgttatgttaatgatatctctatactgcatcatattcggcatggttatggtatattttgtacttttgattgtggactattgataggattgatatagcaataaatctgattcagacttaatattttttaaaacgctagataccatactgtatcataatcctattatatttgacttgaatgcccaaaattttcatagttctatattttatgttaaaaatttagtattacatgttagggatttatttttgtctgctattttcacatacattcttttagaactgagtctgtttctatttagatcatagacgtctaaagaagtattattaattcatgaactgctttgtggaaaaatttaaataaagtatgaaatgactagattaccccaaattgtttatttttttttttggttaatgaccaggttacaattctcagacaaatgaaattggcttgataactgattgaatatagtagataatggaaagtttgactctttaagggcttccaagtgttaaatacattctcaattctgaattacttcatagtaactacttaaataatggtaagccaattctcctttttctttttgagatatttaacacaatttgcgtcttctgatcccattcccttcttccccaaaaaccatgctagaatttaaaattggaagagtttaatttgtcatctacattttagtttttttattctatagataagtaagaagacaagtagacgttctgctgtcaagacagtccatgttattgttggccattcttttcagggataatgcttaatgttatttgtgcgttgtataaggaatgttgtttatcagtatatagacctaccattagtagaaatgatgtatggcaggctttcttgaataatatgtattgtaagtttgtttcctatagtgttattatggttcagattcttttaaaaactagctttatttaaaagtcgacgcggccgcgaat

SEQ ID NO: 301510 - DNA, 3020 bp, Homo sapiens
atggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggtacttagaagttttgattcaatgatcagcaccaactgcacggaggagctggagaacgctggcgtggaggtgctgaagttctcccaggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttgagaaccaggagacacgtgtggcgggcagtgggacccatagatcttctgaaatgaaacaaataatcacattgacttactgtttgagttttatgtatttctttattttaatcaggatcttctgatagtggaaatttttagtacataatagaacttatttatggagttagaaatttgtagtgttatccaggattgattttcatttgatcacatctcacagtaattaatattttcaagttttttttttattaacagctctgtgctagttttttttttctgttttagcctcatcccaaatataaagctttgtgaagtacaattaacttaatgtacttgaatgaatagaacttgctacttttttttttttttttttggagacagagtttggctctcattgcccaggctggagtgcggtggtgctatttcagctccaccacaacctctgcctcctgggttcaagcgattctcctgccttagcctcccgaatagctggaattacaggcacgcaccaccatgcctgactaattttgtatttttagtagacatggggtttctccatgttggtcaggctggtctcaaactcccaccttcaggtgatccgcccacctcggcctcctgaggtgctgagattacaggcgtgagccactgtgccagcttgctaattttcacagaagttgatggcaattcttcacatgtaaacagtgccagtgcacagaacctttatatattttttgaagccagtactgtgctctgcatataacaaagctgcttcaaggatgagacctttttctaaaagcatgtaatgtgagaagccggcctgccttattttcttttttcttttttaatgattaaaaatagtttgtggcaaggcacggtggctcaggcctgtaattctagcactttgggaggccgaggcaggaggattacttgagcctacaagtttgaggccagcatgcacagcatagcaagactgcatctctacagagagtaaaaaaaattacccgagtgtggtgatgtgcatctgtaatctcagctacttgggaggctgaggtgagaggatcacttgagcttgggtgaggtgaggctgcagtgagtcctgatcatgctgctgcactcaatcttggacaacagagcaagaccctgtctcaaaaaaaaaaaaaatatatatatatatatatattatttttatgaggtgaagtgcatcaaacttgggaaagatttgaggaggctgggaacctcctggaaaaccactccttgaagaaagatatgagagacatttagaagtgattcctgctttcagaaggaggtggattcaaatacatcaaaagtcccttcctctgctaagtgtttatagttcaatgaataatttcaatatttgtatgtgttcttgtcattttatttttttctgaaaaacttccaaaaatttgaaaataaaattacagccttttcttctta

SEQ ID NO: 301511 - DNA, 3165 bp, Homo sapiens
atggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggtacttagaagttttgattcaatgatcagcaccaactgcacggaggagctggagaacgctggcgtggaggtgctgaagttctcccaggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttgagaaccaggagacacgtgtggcgggcagtgggacccatagatcttctgaaatgaaacaaataatcacattgacttactgtttgagttttatgtatttctttattttaatcaggatcttctgatagtggaaatttttagtacataatagaacttatttatggagttagaaatttgtagtgttatccaggattgattttcatttgatcacatctcacagtaattaatattttcaagttttttttttattaacagctctgtgctagttttttttttctgttttagcctcatcccaaatataaagctttgtgaagtacaattaacttaatgtacttgaatgaatagaacttgctacttttttttttttttttttggagacagagtttggctctcattgcccaggctggagtgcggtggtgctatttcagctccaccacaacctctgcctcctgggttcaagcgattctcctgccttagcctcccgaatagctggaattacaggcacgcaccaccatgcctgactaattttgtatttttagtagacatggggtttctccatgttggtcaggctggtctcaaactcccaccttcaggtgatccgcccacctcggcctcctgaggtgctgagattacaggcgtgagccactgtgccagcttgctaattttcacagaagttgatggcaattcttcacatgtaaacagtgccagtgcacagaacctttatatattttttgaagccagtactgtgctctgcatataacaaagctgcttcaaggatgagacctttttctaaaagcatgtaatgtgagaagccggcctgccttattttcttttttcttttttaatgattaaaaatagtttgtggcaaggcacggtggctcaggcctgtaattctagcactttgggaggccgaggcaggaggattacttgagcctacaagtttgaggccagcatgcacagcatagcaagactgcatctctacagagagtaaaaaaaattacccgagtgtggtgatgtgcatctgtaatctcagctacttgggaggctgaggtgagaggatcacttgagcttgggtgaggtgaggctgcagtgagtcctgatcatgctgctgcactcaatcttggacaacagagcaagaccctgtctcaaaaaaaaaaaaaatatatatatatatatatattatttttatgaggtgaagtgcatcaaacttgggaaagatttgaggaggctgggaacctcctggaaaaccactccttgaagaaagatatgagagacatttagaagtgattcctgctttcagaaggaggtggattcaaatacatcaaaagtcccttcctctgctaagtgtttatagttcaatgaataatttcaatatttgtatgtgttcttgtcattttatttttttctgaaaaacttccaaaaatttgaaaataaaattacagccttttcttcttataaaatttgttactgtgagctttaattggtacacaggaaattggtttattttctaaggatatttcacattggagaatcagttgcctgtgcttacgggggtgaaaagagagttctcgtataaaaataaagatcgaaggtataaaag

SEQ ID NO: 301512 - DNA, 2940 bp, Homo sapiens
atggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggtacttagaagttttgattcaatgatcagcaccaactgcacggaggagctggagaacgctggcgtggaggtgctgaagttctcccaggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttgagaaccaggagacacgtgtggcgggcagtgggacccatagatcttctgaaatgaaacaaataatcacattgacttactgtttgagttttatgtatttctttattttaatcaggatcttctgatagtggaaatttttagtacataatagaacttatttatggagttagaaatttgtagtgttatccaggattgattttcatttgatcacatctcacagtaattaatattttcaagttttttttttattaacagctctgtgctagttttttttttctgttttagcctcatcccaaatataaagctttgtgaagtacaattaacttaatgtacttgaatgaatagaacttgctacttttttttttttttttttggagacagagtttggctctcattgcccaggctggagtgcggtggtgctatttcagctccaccacaacctctgcctcctgggttcaagcgattctcctgccttagcctcccgaatagctggaattacaggcacgcaccaccatgcctgactaattttgtatttttagtagacatggggtttctccatgttggtcaggctggtctcaaactcccaccttcaggtgatccgcccacctcggcctcctgaggtgctgagattacaggcgtgagccactgtgccagcttgctaattttcacagaagttgatggcaattcttcacatgtaaacagtgccagtgcacagaacctttatatattttttgaagccagtactgtgctctgcatataacaaagctgcttcaaggatgagacctttttctaaaagcatgtaatgtgagaagccggcctgccttattttcttttttcttttttaatgattaaaaatagtttgtggcaaggcacggtggctcaggcctgtaattctagcactttgggaggccgaggcaggaggattacttgagcctacaagtttgaggccagcatgcacagcatagcaagactgcatctctacagagagtaaaaaaaattacccgagtgtggtgatgtgcatctgtaatctcagctacttgggaggctgaggtgagaggatcacttgagcttgggtgaggtgaggctgcagtgagtcctgatcatgctgctgcactcaatcttggacaacagagcaagaccctgtctcaaaaaaaaaattttttttttgtttttacttacgggggaggggtcaacttggaacggcttgggggtggacccctggaacctctgaaagtttggaacttaaggtcccgctcaaaggggggcaaacaaaccccgggaggtagccgaaaacaaagggggagtatttgacaccaaggaatactttctaaaaaaaagcgccggcagcctgaataagaagcgagcgcctaattat

SEQ ID NO: 301513 - DNA, 1739 bp, Homo sapiens
atggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggtacttagaagttttgattcaatgatcagcaccaactgcacggaggagctggagaacgctggcgtggaggtgctgaagttctcccaggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaaggtaggtatttaaaaactgaaggtcatttgtggtttccttcctctttcccctgcccccaactttaaattaggtctctgtcagctgatgaaacctatctcagccccagattacattgctttttggttactctcttgtcacagttccagttttctcccctgctactactttgagtgtacagtatctttccttcacaccaccctatctctttgatcttttttttttagcttttttatttgaactaattttaaatttaaagaaaagctctaaaaataatacaaaggactcctctctaaccttaatatttttgcttttttattttttcactctacacacacacatgtctatctttcctaagaactggcccttacataaaccgagtatcattttctttttttttttctttttgagacaagcttccagcctgggagacaaagcgagactccatctcaaagca

SEQ ID NO: 301514 - DNA, 657 bp, Homo sapiens
tttttttttttttttttttggagacaaaatcttgctctgttcccaggctggagtgcagtggcacgatctcggctcactgcaacctccacctcccaggttcaagtgattctcctgcctcagcctcccaagtagctgggactataggtgcgtgccaccatgcccagctaatttttgtatttttagtagagacagggtttcaccacgttggccaggccacatagattttgaactacatagaaatttgtcttttcaggcaggaacggtgtctcacacctgtaatgagctgagccccagggttcctacctgcccttggggtgggagggtgaacagatccaacagagtctgttcatgaccactgagatcttcattcttcagagaaatgtaaaagttatttagccatcatggcttctgtttctagagagaaaataaaaatgttaactcagggaggatttggttggcagctttccaagcagagactttaacaaaacttgtcaaaacggagactatgttggctgtgaaagtgtttggtttttggcataaaatgttgtgattactttgcaagagaaagagcagtcttgtgtgatctatgttgcctttttctacataggtgccagcttaggaataaccagcgatggattttttcagctggaagaattg

SEQ ID NO: 301515 - DNA, 315 bp, Homo sapiens
taaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggtaagctggcttggtctgcccgaaacatttgtgaatctactaggagtcttatggttttattttccccccagacacccaaaacttgggtggattccattggattcttttctctttttcccatgtattcagtttgtgatcaaatttcattgcttcttcctttgaaatta

SEQ ID NO: 301516 - DNA, 1878 bp, Homo sapiens
agcggccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccaggatcgggagactcaccactagaagacgatgaagtcgggtattcacaccctagatataaagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtggatatggaacctcctagaatcaagtgcccaagtgtgaaggaacgcattgcagaacccaacaaactgacagtccgggtgtcctgggagacacccgaaggaagagacacagcagatggaattcttactgatgtcattctaaaaggcctccccccaggctccaactttccagaaggagaccacaagatccagtacacagtctatgacagagctgagaataagggcacttgcaaatttcgagttaaagtaagagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcagccatgaacgtcaatgtgggtgtcagaacggcagctgcacttctggatcagttttatgagaaaaggagactcctcattgtgtccacacccacagcccgaaacctcctttaccggctccagctaggaatgctgcagcaagcacagtgtggccttgatcttcgacacatcaccgtggtggagctggtgggtgtgttcccgactctcattggcaggataggagcaaagattatgcctccagccctagcgctgcagctcaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctggttgattttgtagagaaattagaacccataaccatacacaggctatcaacatgttattcaatgtgacacctaactcttttctattttgttttttaagtaagacttttattaataaaacaaaatgttttggagcaaa

SEQ ID NO: 301517 - DNA, 1913 bp, Homo sapiens
agcggccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccaggatcgggagactcaccactagaagacgatgaagtcgggtattcacaccctagatataaagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtggatatggaacctcctagaatcaagtgcccaagtgtgaaggaacgcattgcagaacccaacaaactgacagtccgggtgtcctgggagacacccgaaggaagagacacagcagatggaattcttactgatgtcattctaaaaggcctccccccaggctccaactttccagaaggagaccacaagatccagtacacagtctatgacagagctgagaataagggcacttgcaaatttcgagttaaagtaagagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcagccatgaacgtcaatgtgggtgtcagaacggcagctgcacttctggatcagttttatgagaaaaggagactcctcattgtgtccacacccacagcccgaaacctcctttaccggctccagctaggaatgctgcagcaagcacagtgtggccttgatcttcgacacatcaccgtggtggagctggtgggtgtgttcccgactctcattggcaggataggagcaaagattatgcctccagccctagcgctgcagctcaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctggttgattttgtagagaaattagaacccataaccatacacaggctatcaacatgttattcaatgtgacacctaactcttttctattttgttttttaagtaagacttttattaataaaacaaaatgttttggagcaaaaaaaaataaaaaaaatgggcctcgttgggcctaaa

SEQ ID NO: 301518 - DNA, 1963 bp, Homo sapiens
agcggccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccaggatcgggagactcaccactagaagacgatgaagtcgggtattcacaccctagatataaagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtggatatggaacctcctagaatcaagtgcccaagtgtgaaggaacgcattgcagaacccaacaaactgacagtccgggtgtcctgggagacacccgaaggaagagacacagcagatggaattcttactgatgtcattctaaaaggcctccccccaggctccaactttccagaaggagaccacaagatccagtacacagtctatgacagagctgagaataagggcacttgcaaatttcgagttaaagtaagagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcagccatgaacgtcaatgtgggtgtcagaacggcagctgcacttctggatcagttttatgagaaaaggagactcctcattgtgtccacacccacagcccgaaacctcctttaccggctccagctaggaatgctgcagcaagcacagtgtggccttgatcttcgacacatcaccgtggtggagctggtgggtgtgttcccgactctcattggcaggataggagcaaagattatgcctccagccctagcgctgcagctcagtttcataacccttacaaagttggagccatggattttagtctctgaataatgatgtattaaagaagcagaattcaacaaccaaaaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctggttgattttgtagagaaattagaacccataaccatacacaggctatcaacatgttattcaatgtgacacctaactcttttctattttgttttttaagtaagacttttattaataaaacaaaatgttttggagcaaa

SEQ ID NO: 301519 - DNA, 870 bp, Homo sapiens
tgactctgaggagtcttcacaggtcaactggctggctggcacggagcccacctgtgcaccatgaacgtcaatgtgggtgtcagaacggcagctgcacttctggatcagttttatgagaaaaggagactcctcattgtgtccacacccacagcccgaaacctcctttaccggctccagctaggaatgctgcagcaagcacagtgtggccttgatcttcgacacatcaccgtggtggagctggtgggtgtgttcccgactctcattggcaggataggagcaaagattatgcctccagccctagcgctgcagctcaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctggttgattttgtagagaaattagaacccataaccatacacaggctatcaacatgttattcaatgtgacacctaactcttttctattttgttttttaagtaagacttttattaataaaacaaaatgttttggagcaaa

SEQ ID NO: 301520 - DNA, 1756 bp, Homo sapiens
agcggccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccaggatcgggagactcaccactagaagacgatgaagtcgggtattcacaccctagatataaagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtggatatggaacctcctagaatcaagtgcccaagtgtgaaggaacgcattgcagaacccaacaaactgacagtccgggtgtcctgggagacacccgaaggaagagacacagcagatggaattcttactgatgtcattctaaaaggcctccccccaggctccaactttccagaaggagaccacaagatccagtacacagtctatgacagagctgagaataagggcacttgcaaatttcgagttaaagtaagagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcagccatgaacgtcaatgtgggtgtcagaacggcagctgcacttctggatcagttttatgagaaaaggagactcctcattgtgtccacacccacagcccgaaacctcctttaccggctccagctaggaatgctgcaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctggttgattttgtagagaaattagaacccataaccatacacaggctatcaacatgttattcaatgtgacacctaactcttttctattttgttttttaagtaagacttttattaataaaacaaaatgttttggagcaaa

SEQ ID NO: 301521 - DNA, 623 bp, Homo sapiens
gaaacgtgcacttgcaagctgcccgcaatacgttatggcgaccaaacgccttttcggggctacccggacgtgggccggctggggggcctgggagctcctaaaccccgccacttccggaagactcctggcccgggattatgccaagaaaccagttatgaagggggccaaatcgggaaaaggtgcagtgaccagcgaggccctcaaggaccccgacgtatgcacagatcctgtccagctcaccacatatgccatgggcgtcaacatctacaaggaagggcaggatgtacccctgaaaccggatgctgagtaccctgaatggctgtttgagatgaacttgggtcccccaaagaccctggaggagctggaccccgagagccgggagtactggcggcggctgcggaaacagaacatctggcgccacaaccggctgagcaagaacaagaggttgtagcatggagggcccggcatcgctgacccccacgccgagggcttgccgttttcccggaggacgtggacttttgtgagacaagaggcggctccccagcctgggtttccatgtgaccccacagtggggctggaccagggccctggaggccaataaagagctttctgggtagacccta

SEQ ID NO: 301522 - DNA, 926 bp, Homo sapiens
gaaacgtgcacttgcaagctgcccgcaatacgttatggcgaccaaacgccttttcggggctacccggacgtgggccggctggggggcctgggagctcctaaaccccgccacttccggaagactcctggcccgggattatgccaagaaaccagttatgaagggggccaaatcgggaaaaggtgcagtgaccagcgaggccctcaaggaccccgacgtatgcacagatcctgtccagctcaccacatatgccatgggcgtcaacatctacaaggaagggcaggatgtacccctgaaaccggatgctgagtaccctgaatggctgtttgagatgaacttgggtcccccaaagaccctggaggagctggaccccgagagccgggagtactggcggcggctgcggaaacagaacatctggcgccacaaccggctgagcaagaacaagaggttgtagcatggagggcccggcatcgctgacccccacgccgagggcttgccgttttcccggaggacgtggacttttgtgagacaagaggcggctccccagcctgggtttccatgtgaccccacagtggggctggaccagggccctggaggccaataaagagctttctgggtagaccctatttccccttggtattgtctggtgtcggcctggcgggaagtgggtccctcagaccccagggatcccagcctccaccccagccagtggtgggccgtctgcaggtcccctgtgcctccggcccttggtgggcttctctccccaactcctggaattcctgacactgctcacgaggcccggcccaaatctcaagttgctgggtgagggggttgtcctagctaagccactcttggttgcaagggactcaaacctaactatctcaagccatcagagtcagaaaagaggctttatgagcttcaagaaagga

SEQ ID NO: 301523 - DNA, 804 bp, Homo sapiens
gaaacgtgcacttgcaagctgcccgcaatacgttatggcgaccaaacgccttttcggggctacccggacgtgggccggctggggggcctgggagctcctaaaccccgccacttccggaagactcctggcccgggattatgccaagaaaccagttatgaagggggccaaatcgggaaaaggtgcagtgaccagcgaggccctcaaggaccccgacgtatgcacagatcctgtccagctcaccacatatgccatgggcgtcaacatctacaaggaagggcaggatgtacccctgaaaccggatgctgagtaccctgaatggctgtttgagatgaacttgggtcccccaaagaccctggaggagctggaccccgagagccgggagtactggcggcggctgcggaaacagaacatctggcgccacaaccggctgagcaagaacaagaggttgtagcatggagggcccggcatcgctgacccccacgccgagggcttgccgttttcccggaggacgtggacttttgtgagacaagaggcggctccccagcctgggtttccatgtgaccccacagtggggctggaccagggccctggaggccaataaagagctttctgggtagaccctaaaaaaaaaaacaaaaaaaactctctttctctctctctctctctctctctctctctctctctttctcattctctctcttcctctctttcgttcttttcttccttttcctattaatttccctactttttccatctccctctctcattattttcctctcttttaactcttctctgctgcctccg

SEQ ID NO: 301524 - DNA, 557 bp, Homo sapiens
gtagcgcgcagggaaggctggtcaccccaccctaatcttgttatgcaaataggcttcccacttggcaggggccgtcttgtccactcgtttctgtaaacatgggtggcaaaaagagaagatggagctgccatttagaacatgcctaatcccagcttcatcttgctgagcaaaaatgaaggagcctggacccaactttgttactgtgagaaagggtcttcattcattcaagatggcatttgttaagcacctactgctggagtgcagtggttcaatcacggatcactgcagcctccacctcccagttcaagaaattctcatgtctcagcctcctgagcagctaggattacagacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctca

SEQ ID NO: 301525 - DNA, 471 bp, Homo sapiens
cagaagcaagatttaataacaatgcagaacaaggaatcagcaaaacctgttgaaaacgtcagaaaacttaggggaagctggagcagagggttagagttgggagacctgagtgagggtcttggctttcactcagtgtgcagtcaggatccacctaatgtggaataaccatggggttctggaatgggctgagacagtgacatatttgcccatattagtggatccatgaatcattttctacaaagtcttcttgttttgtttttcagacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctca

SEQ ID NO: 301526 - DNA, 835 bp, Homo sapiens
  misc_feature (492)..(492): n is a, c, g, or t
  misc_feature (504)..(505): n is a, c, g, or t
gtagcgcgcagggaaggctggtcaccccaccctaatcttgttatgcaaataggcttcccacttggcaggggccgtcttgtccactcgtttctgtaaacatgggtggcaaaaagagaagatggagctgccatttagaacatgcctaatcccagcttcatcttgctgagcaaaaatgaaggagcctggacccaactttgttactgtgagaaagggtcttcattcattcaagatggcatttgttaagcacctactacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctcaaaaaaaaacaaaagaaaacaaaaaaaaaacantttggggcgctnnggcccaaaaaaggatctaaaacacaatctaggtatggcgaccagagggccacaagaatgagaaactacgaaacatgggggcaacaacgggggggcaacaaaagaaacaccggggggaataagaacattgggtggggtttatcaaccaaataataccacgccggggggaacacacgacggttcggaacaaccccacaaggagatcaggggacagaacggggcacaacacgaggtcaagagggccgagataaatagccgagacggtagagagagcagagcgcagaagagaggagaggaaacaacagagacaagaaaaaggaccgaccacgag

SEQ ID NO: 301527 - DNA, 460 bp, Homo sapiens
gtagcgcgcagggaaggctggtcaccccaccctaatcttgttatgcaaataggcttcccacttggcaggggccgtcttgtccactcgtttctgtaaacatgggtggcaaaaagagaagatggagctgccatttagaacatgcctaatcccagcttcatcttgctgagcaaaaatgaaggagcctggacccaactttgttactgtgagaaagggtcttcattcattcaagatggcatttgttaagcacctactacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctca

SEQ ID NO: 301528 - DNA, 766 bp, Homo sapiens
agcagcagttggaaatgatgtagaatctggggagagaccttttaaagaaaggtgatatcaaggcttgtttgtggactgagaatgatgtgtgatcttggaagtcagcttgagaatggagcagtcaagacacaaattggttggcaggtcatgatcagcatgagaggaatctctatcctgcttccaggctatccttggcactgtgatttttaataaaataatgcactgactttgcattcaaagaaattactggacagtcaaaatatacacacatatgcaaaaattgaggagcaatttcccataagatacaaaccttggaaatcaagaaagttctggaatgatgaagctgttcatgccaagaccgaaagtgctggcccagtatgagtccattcagttcatgccgtgacaattttcttggaactcctttttattgcttgtgctcctggtacatcagcccatttcatggtacgttgaagcatgcctccctgtgggattgctggattcccagcccagtgaggtaatgaccaagcagcgtcttcagaggaaggatagctgtacagcgtggtgaaggactcaatgagaaggtgcattgcccatccttcagagagctctgtgtgaatccataaaaggtgcttaaagcttttcactccatgaagcctcatctgtctcatgaaagcaataaatgcctggaggttcatccatcaagtgaggggccttaaccatgtttccaacaacagcctttccggccccatcttcctatgaaggagaa

SEQ ID NO: 301529 - DNA, 490 bp, Homo sapiens
cagaagcaagatttaataacaatgcagaacaaggaatcagcaaaacctgttgaaaacgtcagaaaacttaggggaagctggagcagagggttagagttgggagacctgagtgagggtcttggctttcactcagtgtgcagtcaggatccacctaatgtggaataaccatggggttctggaatgggctgagacagtgacatatttgcccatattagtggatccatgaatcattttctacaaagtcttcttgttttgtttttcagacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctcactgcacaaacatctttcct

SEQ ID NO: 301530 - DNA, 717 bp, Homo sapiens
gtagcgcgcagggaaggctggtcaccccaccctaatcttgttatgcaaataggcttcccacttggcaggggccgtcttgtccactcgtttctgtaaacatgggtggcaaaaagagaagatggagctgccatttagaacatgcctaatcccagcttcatcttgctgagcaaaaatgaaggagcctggacccaactttgttactgtgagaaagggtcttcattcattcaagatggcatttgttaagcacctactgtgagtagatgatctcctgtcaaagacagttaacaaatcctcggaatattgcttcatgtacagttattggagatgagtaacttacattctcttaattgtaatggttccttggaaagtcatcgtggaaaatgaaggctggctcatacattttcccagacaggaatttggctgccaacagggaattctaaacaactaaaaactccagatgatgaatgcacaacataatgatggttaaattaaaaaaaaaaaagagcacgacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctca

SEQ ID NO: 301531 - DNA, 736 bp, Homo sapiens
gtagcgcgcagggaaggctggtcaccccaccctaatcttgttatgcaaataggcttcccacttggcaggggccgtcttgtccactcgtttctgtaaacatgggtggcaaaaagagaagatggagctgccatttagaacatgcctaatcccagcttcatcttgctgagcaaaaatgaaggagcctggacccaactttgttactgtgagaaagggtcttcattcattcaagatggcatttgttaagcacctactgtgagtagatgatctcctgtcaaagacagttaacaaatcctcggaatattgcttcatgtacagttattggagatgagtaacttacattctcttaattgtaatggttccttggaaagtcatcgtggaaaatgaaggctggctcatacattttcccagacaggaatttggctgccaacagggaattctaaacaactaaaaactccagatgatgaatgcacaacataatgatggttaaattaaaaaaaaaaaagagcacgacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctcactgcacaaacatctttcct

SEQ ID NO: 301532 - DNA, 610 bp, Homo sapiens
gtagcgcgcagggaaggctggtcaccccaccctaatcttgttatgcaaataggcttcccacttggcaggggccgtcttgtccactcgtttctgtaaacatgggtggcaaaaagagaagatggagctgccatttagaacatgcctaatcccagcttcatcttgctgagcaaaaatgaaggagcctggacccaactttgttactgtgagaaagggtcttcattcattcaagatggcatttgttaagcacctactgctggagtgcagtggttcaatcacggatcactgcagcctccacctcccagttcaagaaattctcatgtctcagcctcctgagcagctaggattacagacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctcataaaacacaaaaacgcgaaaatacgaaatgaatgtggcctgagttggcctcaa

SEQ ID NO: 301533 - DNA, 608 bp, Homo sapiens
gtagcgcgcagggaaggctggtcaccccaccctaatcttgttatgcaaataggcttcccacttggcaggggccgtcttgtccactcgtttctgtaaacatgggtggcaaaaagagaagatggagctgccatttagaacatgcctaatcccagcttcatcttgctgagcaaaaatgaaggagcctggacccaactttgttactgtgagaaagggtcttcattcattcaagatggcatttgttaagcacctactgctggagtgcagtggttcaatcacggatcactgcagcctccacctcccagttcaagaaattctcatgtctcagcctcctgagcagctaggattacagacaaaccttggaaatcaagaaagttctggaatgatgaagctgttcatgccaagaccgaaagtgctggcccagtatgagtccattcagttcatgccgtgacaattttcttggaactcctttttattgttagttctcacttgtttccatatttagtgaatgtacatttaattgcaaagctgtcattaataaaaattcttatagtacctcaaaaataaaaatagaaaacataaaataaaaataatggccttcgttggcctca

SEQ ID NO: 301534 - DNA, 911 bp, Homo sapiens
ctgttcatttctgttttgtagttgatgtcagtaacacccaaacaatgcccatgtttgttttcattaatttagcatattgctgtgaggactggttaagccagaaatacttatcattagtgtgatcttggctaccatgtaaaacaatggtttttgcctacttcaagagcttttgtaattaccaaaccgtctaccttcctaacttgctatattaatgctgatgcttgaaagtaagatctttggcatttatgcttacacgttgcatgaagagtaagttgagtacaacatgttatgccatgtattaagtctattaattaaaaacaaattctaagattcaaggagcttttcagtgttccacatttctccctttagaaaaagtaaatgtgtgcagaattaacaaagtgtttaaaaatagatatttattattttactatttggatgaatgtgtagggcagtgcttccttggcactggggatatttcattgagcaaaactaaaaatatcttccctcatggagtttatgttatagtaagacatacatgtacctctataataactattacgttagaaggtataaagtattgtgaaaaatatatagagcagtagtggagtgggaagaaatgttttgaaatagagcttgagattcttgattgtcttgccctctacttgaacagtgtcttctaggaagcccagacacatggagaagttctgagtgttttggccgatagtcccagatgaggttccagcaacagctgggatcacccatgagatgtgagtgaggaaggctttgagatggtttcagccctagccaccactgacctcataagagaccacaagaatgagaatcacctggccaagcccagcagaccttcagaattcagaaataaaataattcatcttattttaaaaaaaagt

SEQ ID NO: 301535 - DNA, 915 bp, Homo sapiens
  misc_feature (495)..(495): n is a, c, g, or t
  misc_feature (607)..(607): n is a, c, g, or t
  misc_feature (615)..(615): n is a, c, g, or t
  misc_feature (628)..(628): n is a, c, g, or t
  misc_feature (630)..(630): n is a, c, g, or t
  misc_feature (634)..(634): n is a, c, g, or t
  misc_feature (636)..(636): n is a, c, g, or t
  misc_feature (644)..(644): n is a, c, g, or t
  misc_feature (654)..(654): n is a, c, g, or t
  misc_feature (912)..(912): n is a, c, g, or t
gatgagaatgaaggctgaggtgtgcgccttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactggtaagctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggaaaggagaaagagancacctactgcatttctgtcactcgctgaaaaggacactctgtcagaaaatcttctagcaaacttcaaagggcaaatcaccccttgttactgataaagccagagagcttcagnagttaaantccctgacgggcncngcangntttgaccnaggtcagttnggcagacaccaaagcttcataactcagtgtctatctcccaagataggtccatactgttataatcaccttgtgcacagggttactcatcgatttcaggcaatgacttaatatcaggtgcaacgtgcgtcttgctttgggactgcaactgctgtagcttgacccgaatataacgaagagggccagacgggttccacaaacattcaaggaccggtaaacacttcgtggtcacctccttttagtttagattccctcgcaggnaaa

SEQ ID NO: 301536 - DNA, 1002 bp, Homo sapiens
  misc_feature (849)..(849): n is a, c, g, or t
gatgagaatgaaggctgaggtgtgcgccttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactataagaacaagatgggggtgacattttctttttttttttggcaacacgggggctcttgtgcctctgtgttcccccgggcttaaagttgcagcgggtgcgaactctctcgagttcacccgtgcacattctccggcctctccgcgggttcacaaggccaatattcttcgccaactctttcagacctctcgcgaaagttaacaccggggatattaacacgagggggggcgtgtgcacccacacacaaacacaccctgtgggcctatatatatcataggcgacctatatatctagagattcagacaatgtgaggggtattacaaactggtgtgtgtctgtgcgccccagagagcctgtgtgcaccctgtgaaaactctccctgtgacacccctcaggcggttacaccccccacactggtgccttctgcggggacctctcccccaagagagtgggccgtcggaaaaatacacagggcgcgtcgtaaagcccacaggtctgcccccccgcgtgccacaacaaacgtgggggcgatacaatatcgcagaggcttcccaagaaacccccacgacgtcgtgcgacacnactctctaagcgggcagtgaagaccctctcgccgacaatgtggtacacacctcttagagtgaaaagcccccctcttggcttagaaaacatcttcttcacaaagcaggcttcataactaagaaacagcgcaagcattaattatgtcctcccccc

SEQ ID NO: 301537 - DNA, 395 bp, Homo sapiens
aattagttgtctttagagcaaaaatccgtctaagagtgcagtgtggtttcctatgcacaatctggaatagtccattgcttcatgcctaccctggacatgaagggccgtgccacagtggaagtctctatgcatccacccctgtctatacctgagcaactcattcctctttgctgctctcttacaggctacagagtgcggtggcgccagcacagaactctgctcaatgtccctctgtgctttcacgatgctgatggattatgaaggtagggaagaatgtacagccaggaggccattaggagggcaactaatttataaaatcgcatttgtagaatttaatgcatccaacacctaccaggggaaaggtgggcaaaagctataccaacaccacccaagtc

SEQ ID NO: 301538 - DNA, 4650 bp, Homo sapiens
gatgagaatgaaggctgaggtgtgcgccttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaatgcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcaccgctaaagaaaacaaaatatgctgccactaatttgccaccaccctgtgagcatgattggatgatgtttattttgattaggagattgctccatttataaatcttcaatacatcctgtccccctaaaacggcatctgggtcttttgagggttaaaaaaaaaaaaaagtgaaattggatgagggatgagagctggacttctgtgtgtcccggggtccctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaactacccggctctgcagaagcacgctgggcccaggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctcccgcgcccgagaagcccagcctcgccggcggccaagttcaccgcgaggccccgcgctgcctgcgctgcgctcccggacccgcaccgaccgcagcgcgcgccgccggtgcttctcccaccccagcctggaagctgcctccctccgcctatgcctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtgtctctccctcctaagccccggaggggagaacttccaaagacagaaaaccacaggcttctggcacagagctttccctttatcagctaaagcagaatcttttctggccttaacctggccccttcctctaactgcaggcagagaggcagacagaaaagcacttgctgaaacacaaagttttgttctgtcctcaacgaactgtctagagctgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgtcatttctaaaacccattatcactgtatgagagattcctttgcgctgcatcctcgacagtgcttcctaaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatgtttgactttgaaggatcactttcccctgtcattgcgcccaaaaaagcaaggccttctgagactggatctgatgatgactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaatttttttcgttcttcgccttgtgtatgaggagcttaagttgaatactctaatgggagaaggaatttgttcactcttgaacttctcgttcagttggcaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttgagtattgcactgtacatacttggtgatgagagctcagtttctgatgaatcctcacagtatttaaccagaataactgtagccccccagaagttgcaagcagaacaagaggaaaacaggtttagtttcaggcattctacgtctgtttctagtctagctgaaagattggttggctggatgactaatgtaggattcactttaagagatttggaaactcttccctttggaattgctcttcccatcagagatgcaatttatcactgtcgtgagcagcctgcctcagactggccagaagctgtctgtctcttgactggacgtcaggatctttccaagcaggcctgcgaaggaaacttacccaaagggaagtctgtgctctcatcagatgttccttcaggtacagaaactgaggaggaagatgacggcatgaatgacatgaatcacgaggtcatgtcattaatatggagtgaagatttacgggtgcaggatgtgcgaaggcttcttcagagtgcgcatcctgtccgtgtcaacgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagaaagtcatactccttagctgctggcttggccctgggcatggtctgcttggggcatggcagcaatttgataggtatgtctgatctcaatgtgcctgagcagctctatcagtacatggttggaggacataggcgctttcaaacaggaatgcatagggagaaacataaatcaccaagttatcaaatcaaagaaggagataccataaatgtggatgtgacttgtccaggtgctactctagctttggctatgatctacttaaaaaccaataacagtgtcttctaggaagcccagacacatggagaagttctgagtgttttggccgatagtcccagatgaggttccagcaacagctgggatcacccatgagatgtgagtgaggaaggctttgagatggtttcagccctagccaccactgacctcataagagaccacaagaatgagaatcacctggccaagcccagcagaccttcagaattcagaaataaaataattcatcttattttaaaaaaaagt

SEQ ID NO: 301539 - DNA, 2729 bp, Homo sapiens
gatgagaatgaaggctgaggtgtgcgccttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactggtaagctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatgtttgactttgaaggatcactttcccctgtcattgcgcccaaaaaagcaaggccttctgagactggatctgatgatgactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaatttttttcgttcttcgccttgtgtatgaggagcttaagttgaatactctaatgggagaaggaatttgttcactcttgaacttctcgttcagttggcaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttgagtattgcactgtacatacttggtgatgagagctcagtttctgatgaatcctcacagtatttaaccagaataactgtagccccccagaagttgcaagcagaacaagaggaaaacaggtttagtttcaggcattctacgtctgtttctagtctagctgaaagattggttggctggatgactaatgtaggattcactttaagagatttggaaactcttccctttggaattgctcttcccatcagagatgcaatttatcactgtcgtgagcagcctgcctcagactggccagaagctgtctgtctcttgactggacgtcaggatctttccaagcaggcctgcgaaggaaacttacccaaagggaagtctgtgctctcatcagatgttccttcaggtacagaaactgaggaggaagatgacggcatgaatgacatgaatcacgaggtcatgtcattaatatggagtgaagatttacgggtgcaggatgtgcgaaggcttcttcagagtgcgcatcctgtccgtgtcaacgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagaaagtcatactccttagctgctggcttggccctgggcatggtctgcttggggcatggcagcaatttgataggtatgtctgatctcaatgtgcctgagcagctctatcagtacatggttggaggacataggcgctttcaaacaggaatgcatagggagaaacataaatcaccaagttatcaaatcaaagaaggagataccataaatgtggatgtgacttgtccaggtgctactctagctttggctatgatctacttaaaaaccaataacagtgtcttctaggaagcccagacacatggagaagttctgagtgttttggccgatagtcccagatgaggttccagcaacagctgggatcacccatgagatgtgagtgaggaaggctttgagatggtttcagccctagccaccactgacctcataagagaccacaagaatgagaatcacctggccaagcccagcagaccttcagaattcagaaataaaataattcatcttattttaaaaaaaagt

SEQ ID NO: 301540 - DNA, 3188 bp, Homo sapiens
gatgagaatgaaggctgaggtgtgcgccttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactggtaagtcctcaacgaactgtctagagctgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgtcatttctaaaacccattatcactgtatgagagattcctttgcgctgcatcctcgacagtgcttcctaaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatgtttgactttgaaggatcactttcccctgtcattgcgcccaaaaaagcaaggccttctgagactggatctgatgatgactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaatttttttcgttcttcgccttgtgtatgaggagcttaagttgaatactctaatgggagaaggaatttgttcactcttgaacttctcgttcagttggcaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttgagtattgcactgtacatacttggtgatgagagctcagtttctgatgaatcctcacagtatttaaccagaataactgtagccccccagaagttgcaagcagaacaagaggaaaacaggtttagtttcaggcattctacgtctgtttctagtctagctgaaagattggttggctggatgactaatgtaggattcactttaagagatttggaaactcttccctttggaattgctcttcccatcagagatgcaatttatcactgtcgtgagcagcctgcctcagactggccagaagctgtctgtctcttgactggacgtcaggatctttccaagcaggcctgcgaaggaaacttacccaaagggaagtctgtgctctcatcagatgttccttcaggtacagaaactgaggaggaagatgacggcatgaatgacatgaatcacgaggtcatgtcattaatatggagtgaagatttacgggtgcaggatgtgcgaaggcttcttcagagtgcgcatcctgtccgtgtcaacgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagaaagtcatactccttagctgctggcttggccctgggcatggtctgcttggggcatggcagcaatttgataggtatgtctgatctcaatgtgcctgagcagctctatcagtacatggttggaggacataggcgctttcaaacaggaatgcatagggagaaacataaatcaccaagttatcaaatcaaagaaggagataccataaatgtggatgtgacttgtccaggtgctactctagctttggctatgatctacttaaaaaccaataacagtgtcttctaggaagcccagacacatggagaagttctgagtgttttggccgatagtcccagatgaggttccagcaacagctgggatcacccatgagatgtgagtgaggaaggctttgagatggtttcagccctagccaccactgacctcataagagaccacaagaatgagaatcacctggccaagcccagcagaccttcagaattcagaaataaaataattcatcttattttaaaaaaaagt

SEQ ID NO: 301541 - DNA, 4814 bp, Homo sapiens
gatgagaatgaaggctgaggtgtgcgccttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaatgcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcaccgctaaagaaaacaaaatatgctgccactaatttgccaccaccctgtgagcatgattggatgatgtttattttgattaggagattgctccatttataaatcttcaatacatcctgtccccctaaaacggcatctgggtcttttgagggttaaaaaaaaaaaaaagtgaaattggatgagggatgagagctggacttctgtgtgtcccggggtccctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaactacccggctctgcagaagcacgctgggcccaggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctcccgcgcccgagaagcccagcctcgccggcggccaagttcaccgcgaggccccgcgctgcctgcgctgcgctcccggacccgcaccgaccgcagcgcgcgccgccggtgcttctcccaccccagcctggaagctgcctccctccgcctatgcctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtgtctctccctcctaagccccggaggggagaacttccaaagacagaaaaccacaggcttctggcacagagctttccctttatcagctaaagcagaatcttttctggccttaacctggccccttcctctaactgcaggcagagaggcagacagaaaagcacttgctgaaacacaaagttttgttctgtcctcaacgaactgtctagagctgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgtcatttctaaaacccattatcactgtatgagagattcctttgcgctgcatcctcgacagtgcttcctaaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatgtttgactttgaaggatcactttcccctgtcattgcgcccaaaaaagcaaggccttctgagactggatctgatgatgactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaatttttttcgttcttcgccttgtgtatgaggagcttaagttgaatactctaatgggagaaggaatttgttcactcttgaacttctcgttcagttggcaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttgagtattgcactgtacatacttggtgatgagagctcagtttctgatgaatcctcacagtatttaaccagaataactgtagccccccagaagttgcaagcagaacaagaggaaaacaggtttagtttcaggcattctacgtctgtttctagtctagctgaaagattggttggctggatgactaatgtaggattcactttaagagatttggaaactcttccctttggaattgctcttcccatcagagatgcaatttatcactgtcgtgagcagcctgcctcagactggccagaagctgtctgtctcttgactggacgtcaggatctttccaagcaggcctgcgaaggaaacttacccaaagggaagtctgtgctctcatcagatgttccttcaggtacagaaactgaggaggaagatgacggcatgaatgacatgaatcacgaggtcatgtcattaatatggagtgaagatttacgggtgcaggatgtgcgaaggcttcttcagagtgcgcatcctgtccgtgtcaacgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagaaagtcatactccttagctgctggcttggccctgggcatggtctgcttggggcatggcagcaatttgataggtatgtctgatctcaatgtgcctgagcagctctatcagtacatggttggaggacataggcgctttcaaacaggaatgcatagggagaaacataaatcaccaagttatcaaatcaaagtaagtacacagcaaagtaatagatcaaaagtctggaagctgggaagttaattggaaaatactagtgttcatcctgacattggtaaatatgttaattttaagcatacttatcagaggaattttataaaaatttagaactcttttacatgcataaactcttctttgaaggagataccataaatgtggatgtgacttgtccaggtgctactctagctttggctatgatctacttaaaaaccaataacagtgtcttctaggaagcccagacacatggagaagttctgagtgttttggccgatagtcccagatgaggttccagcaacagctgggatcacccatgagatgtgagtgaggaaggctttgagatggtttcagccctagccaccactgacctcataagagaccacaagaatgagaatcacctggccaagcccagcagaccttcagaattcagaaataaaataattcatcttattttaaaaaaaagt

SEQ ID NO: 301542 - DNA, 4515 bp, Homo sapiens
gatgagaatgaaggctgaggtgtgcgccttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaatgcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcaccgctaaagaaaacaaaatatgctgccactaatttgccaccaccctgtgagcatgattggatgatgtttattttgattaggagattgctccatttataaatcttcaatacatcctgtccccctaaaacggcatctgggtcttttgagggttaaaaaaaaaaaaaagtgaaattggatgagggatgagagctggacttctgtgtgtcccggggtccctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaactacccggctctgcagaagcacgctgggcccaggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctcccgcgcccgagaagcccagcctcgccggcggccaagttcaccgcgaggccccgcgctgcctgcgctgcgctcccggacccgcaccgaccgcagcgcgcgccgccggtgcttctcccaccccagcctggaagctgcctccctccgcctatgcctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtgtctctccctcctaagccccggaggggagaacttccaaagacagaaaaccacaggcttctggcacagagctttccctttatcagctaaagcagaatcttttctggccttaacctggccccttcctctaactgcaggcagagaggcagacagaaaagcacttgctgaaacacaaagttttgttctgtcctcaacgaactgtctagagctgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgtcatttctaaaacccattatcactgtatgagagattcctttgcgctgcatcctcgacagtgcttcctaaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatgtttgactttgaaggatcactttcccctgtcattgcgcccaaaaaagcaaggccttctgagactggatctgatgatgactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaatttttttcgttcttcgccttgtgtatgaggagcttaagttgaatactctaatgggagaaggaatttgttcactcttgaacttctcgttcagttggcaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttgagtattgcactgtacatacttggtgatgagagctcagtttctgatgaatcctcacagtatttaaccagaataactgtagccccccagaagttgcaagcagaacaagaggaaaacaggtttagtttcaggcattctacgtctgtttctagtctagctgaaagattggttggctggatgactaatgtaggattcactttaagagatttggaaactcttccctttggaattgctcttcccatcagagatgcaatttatcactgtcgtgagcagcctgcctcagactggccagaagctgtctgtctcttgactggacgtcaggatctttccaagcaggcctgcgaaggaaacttacccaaagggaagtctgtgctctcatcagatgttccttcaggtacagaaactgaggaggaagatgacggcatgaatgacatgaatcacgaggtcatgtcattaatatggagtgaagatttacgggtgcaggatgtgcgaaggcttcttcagagtgcgcatcctgtccgtgtcaacgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagaaagtcatactccttagctgctggcttggccctgggcatggtctgcttgggggaaggagataccataaatgtggatgtgacttgtccaggtgctactctagctttggctatgatctacttaaaaaccaataacagtgtcttctaggaagcccagacacatggagaagttctgagtgttttggccgatagtcccagatgaggttccagcaacagctgggatcacccatgagatgtgagtgaggaaggctttgagatggtttcagccctagccaccactgacctcataagagaccacaagaatgagaatcacctggccaagcccagcagaccttcagaattcagaaataaaataattcatcttattttaaaaaaaagt

SEQ ID NO: 301543 - DNA, 4620 bp, Homo sapiens
gatgagaatgaaggctgaggtgtgcgccttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaatgcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcaccgctaaagaaaacaaaatatgctgccactaatttgccaccaccctgtgagcatgattggatgatgtttattttgattaggagattgctccatttataaatcttcaatacatcctgtccccctaaaacggcatctgggtcttttgagggttaaaaaaaaaaaaaagtgaaattggatgagggatgagagctggacttctgtgtgtcccggggtccctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaactacccggctctgcagaagcacgctgggcccaggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctcccgcgcccgagaagcccagcctcgccggcggccaagttcaccgcgaggccccgcgctgcctgcgctgcgctcccggacccgcaccgaccgcagcgcgcgccgccggtgcttctcccaccccagcctggaagctgcctccctccgcctatgcctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtgtctctccctcctaagccccggaggggagaacttccaaagacagaaaaccacaggcttctggcacagagctttccctttatcagctaaagcagaatcttttctggccttaacctggccccttcctctaactgcaggcagagaggcagacagaaaagcacttgctgaaacacaaagttttgttctgtcctcaacgaactgtctagagctgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgtcatttctaaaacccattatcactgtatgagagattcctttgcgctgcatcctcgacagtgcttcctaaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatgtttgactttgaaggatcactttcccctgtcattgcgcccaaaaaagcaaggccttctgagactggatctgatgatgactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaatttttttcgttcttcgccttgtgtatgaggagcttaagttgaatactctaatgggagaaggaatttgttcactcttgaacttctcgttcagttggcaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttgagtattgcactgtacatacttggtgatgagagctcagtttctgatgaatcctcacagtatttaaccagaataactgtagccccccagaagttgcaagcagaacaagaggaaaacaggtttagtttcaggcattctacgtctgtttctagtctagctgaaagattggttggctggatgactaatgtaggattcactttaagagatttggaaactcttccctttggaattgctcttcccatcagagatgcaatttatcactgtcgtgagcagcctgcctcagactggccagaagctgtctgtctcttgactggacgtcaggatctttccaagcaggcctgcgaaggaaacttacccaaagggaagtctgtgctctcatcagatgttccttcaggtacagaaactgaggaggaagatgacggcatgaatgacatgaatcacgaggtcatgtcattaatatggagtgaagatttacgggtgcaggatgtgcgaaggcttcttcagagtgcgcatcctgtccgtgtcaacgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagaaagtcatactccttagctgctggcttggccctgggcatggtctgcttggggcatggcagcaatttgataggtatgtctgatctcaatgtgcctgagcagctctatcagtacatggttggaggacataggcgctttcaaacaggaatgcatagggagaaacataaatcaccaagttatcaaatcaaagaaggagataccataaatgtggatgtgacttgtccaggtgctactctagctttggctatgatctacttaaaaaccaataacaggctacagagtgcggtggcgccagcacagaactctgctcaatgtccctctgtgctttcacgatgctgatggattatgaaggtagggaagaatgtacagccaggaggccattaggagggcaactaatttataaaatcgcatttgtagaatttaatgcatccaacacctaccaggggaaaggtgggcaaaagctataccaacaccacccaagtc

SEQ ID NO: 301544 - DNA, 4669 bp, Homo sapiens
gatgagaatgaaggctgaggtgtgcgccttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaatgcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcaccgctaaagaaaacaaaatatgctgccactaatttgccaccaccctgtgagcatgattggatgatgtttattttgattaggagattgctccatttataaatcttcaatacatcctgtccccctaaaacggcatctgggtcttttgagggttaaaaaaaaaaaaaagtgaaattggatgagggatgagagctggacttctgtgtgtcccggggtccctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaactacccggctctgcagaagcacgctgggcccaggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctcccgcgcccgagaagcccagcctcgccggcggccaagttcaccgcgaggccccgcgctgcctgcgctgcgctcccggacccgcaccgaccgcagcgcgcgccgccggtgcttctcccaccccagcctggaagctgcctccctccgcctatgcctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtgtctctccctcctaagccccggaggggagaacttccaaagacagaaaaccacaggcttctggcacagagctttccctttatcagctaaagcagaatcttttctggccttaacctggccccttcctctaactgcaggcagagaggcagacagaaaagcacttgctgaaacacaaagttttgttctgtcctcaacgaactgtctagagctgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgtcatttctaaaacccattatcactgtatgagagattcctttgcgctgcatcctcgacagtgcttcctaaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatgtttgactttgaaggatcactttcccctgtcattgcgcccaaaaaagcaaggccttctgagactggatctgatgatgactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaatttttttcgttcttcgccttgtgtatgaggagcttaagttgaatactctaatgggagaaggaatttgttcactcttgaacttctcgttcagttggcaaggtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttgagtattgcactgtacatacttggtgatgagagctcagtttctgatgaatcctcacagtatttaaccagaataactgtagccccccagaagttgcaagcagaacaagaggaaaacaggtttagtttcaggcattctacgtctgtttctagtctagctgaaagattggttggctggatgactaatgtaggattcactttaagagatttggaaactcttccctttggaattgctcttcccatcagagatgcaatttatcactgtcgtgagcagcctgcctcagactggccagaagctgtctgtctcttgactggacgtcaggatctttccaagcaggcctgcgaaggaaacttacccaaagggaagtctgtgctctcatcagatgttccttcaggtacagaaactgaggaggaagatgacggcatgaatgacatgaatcacgaggtcatgtcattaatatggagtgaagatttacgggtgcaggatgtgcgaaggcttcttcagagtgcgcatcctgtccgtgtcaacgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagaaagtcatactccttagctgctggcttggccctgggcatggtctgcttggggcatggcagcaatttgataggtatgtctgatctcaatgtgcctgagcagctctatcagtacatggttggaggacataggcgctttcaaacaggaatgcatagggagaaacataaatcaccaagttatcaaatcaaagtaagtacacagcaaagtaatagatcaaaagtctggaagctgggaagttaattggaaaatactagtgttcatcctgacattggtaaatatgttaattttaagcatacttatcagaggaattttataaaaatttagaactcttttacatgcataaactcttctttgaaggagataccataaatgtggatgtgacttgtccaggtgctactctagctttggctatgatctacttaaaaaccaataacaggtatttctacccactcacccttcctcccacggtgatagtgtgatatcctctctgaccttggttgtaaaattcagttatctcatgtgtttctttccc

SEQ ID NO: 301545 - DNA, 2537 bp, Homo sapiens
gatgagaatgaaggctgaggtgtgcgccttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaatgcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcaccgctaaagaaaacaaaatatgctgccactaatttgccaccaccctgtgagcatgattggatgatgtttattttgattaggagattgctccatttataaatcttcaatacatcctgtccccctaaaacggcatctgggtcttttgagggttaaaaaaaaaaaaaagtgaaattggatgagggatgagagctggacttctgtgtgtcccggggtccctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaactacccggctctgcagaagcacgctgggcccaggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctcccgcgcccgagaagcccagcctcgccggcggccaagttcaccgcgaggccccgcgctgcctgcgctgcgctcccggacccgcaccgaccgcagcgcgcgccgccggtgcttctcccaccccagcctggaagctgcctccctccgcctatgcctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtgtctctccctcctaagccccggaggggagaacttccaaagacagaaaaccacaggcttctggcacagagctttccctttatcagctaaagcagaatcttttctggccttaacctggccccttcctctaactgcaggcagagaggcagacagaaaagcacttgctgaaacacaaagttttgttctgtcctcaacgaactgtctagagctgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgtcatttctaaaacccattatcactgtatgagagattcctttgcgctgcatcctcgacagtgcttcctaaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggtaagttttctaagttttctttttgtctcccatatacgctgggctgtgctggaatcaccaacaggcacagaaaaaatgacaacaaaacaacaacaaaacccccaagaatatcctgttgtctttggccaaagttcagg

SEQ ID NO: 301546 - DNA, 616 bp, Homo sapiens
gatgagaatgaaggctgaggtgtgcgccttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactggtaagctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggtaagttttctaagttttctttttgtctcccatatacgctgggctgtgctggaatcaccaacaggcacagaaaaaatgacaacaaaacaacaacaaaacccccaagaatatcctgttgtctttggccaaagttcagg

SEQ ID NO: 301547 - DNA, 683 bp, Homo sapiens
gtatgtatgtggagtgttactacctatctcctttttcttttaaaatttagttttaaaaagtacacctaatattaagtttttcttctgtgtatagttctgtgaatttcagtacgtgtatagattcatgtaattactacaatgaggatatagaacatttacatcaccctcaaaaatttctctcatgattttgagactcatccaagttgtttcctgtatcgacagttcattgcattctatggctaattagtagtttattgcatgaatgtgtcatagttggtttttcattcaagataattgggttgatttcagttgttagcaattgtaaatatagatgctgtcagcattcatgcttagcgttttatgtgaacataagttttgctttctctaggacaggtacctaggagtaggattgatgggtcatacagttaagtttatattttgtttttaaagaaactgtcatctgttttccagagtggctcttccattttacatttttaccagcaatatttaagagatcatttacctgcattcttgttggtatttggtattgtcactcttttttatttttgtctttctgagagatgtgtagttatacctcattgtggttttaatttgcattttcctaatggctaatgatgttttcagcgttctaggtatgaggttttgtcagatatgtggtttgc

SEQ ID NO: 301548 - DNA, 383 bp, Homo sapiens
ggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgtcatttctaaaacccattatcactgtatgagagattcctttgcgctgcatcctcgacagtgcttcctaaggtcagtcttttctattgtattcattttaatgggtgcatagccgtatctcgttgtgattttaatgtgcatctccctagtgac

SEQ ID NO: 301549 - DNA, 4137 bp, Homo sapiens
tcaagctcgccccgcgcagcccgagccgggctgggcgctgtcctcgggggcctggggaaccgcgcggtttggagatcggaggcacctggaacccgtggcaagcgccgagccgggagacagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcgcgttcatcggtccccgcctgagacgcgcccactcctgcccggacttccagccccggaggcgccggacagagccgcggactccagcgcccaccatgcgcctcaacagctccgcgccgggaaccccgggcacgccggccgccgaccccttccagcgggcgcaggccggactggaggaggcgctgctggccccgggcttcggcaacgcttcgggcaacgcgtcggagcgcgtcctggcggcacccagcagcgagctggacgtgaacaccgacatctactccaaagtgctggtgaccgccgtgtacctggcgctcttcgtggtgggcacggtgggcaacacggtgacggcgttcacgctggcgcggaagaagtcgctgcagagcctgcagagcacggtgcattaccacctgggcagcctggcgctgtccgacctgctcaccctgctgctggccatgcccgtggagctgtacaacttcatctgggtgcaccacccctgggccttcggcgacgccggctgccgcggctactacttcctgcgcgacgcctgcacctacgccacggccctcaacgtggccagcctgagtgtggagcgctacctggccatctgccaccccttcaaggccaagaccctcatgtcccgaagccgcaccaagaagttcatcagcgccatctggctcgcctcggccctgctgacggtgcctatgctgttcaccatgggcgagcagaaccgcagcgccgacggccagcacgccggcggcctggtgtgcacccccaccatccacactgccaccgtcaaggtcgtcatacaggtcaacaccttcatgtccttcatattccccatggtggtcatctcggtcctgaacaccatcatcgccaacaagctgaccgtcatggtacgccaggcggccgagcagggccaagtgtgcacggtcgggggcgagcacagcacattcagcatggccatcgagcctggcagggtccaggccctgcggcacggcgtgcgcgtcctacgtgcagtggtcatcgcctttgtggtctgctggctgccctaccacgtgcggcgcctcatgttctgctacatctcggatgagcagtggactccgttcctctatgacttctaccactacttctacatggtgaccaacgcactcttctacgtcagctccaccatcaaccccatcctgtacaacctcgtctctgccaacttccgccacatcttcctggccacactggcctgcctctgcccggtgtggcggcgcaggaggaagaggccagccttctcgaggaaggccgacagcgtgtccagcaaccacaccctctccagcaatgccacccgcgagacgctgtactaggctgtgcgccccggaacgtgtccaggaggagcctggccatgggtccttgcccccgacagacagagcagcccccacccgggagccttgatgggggtcaggcagaggccagcctgcactggagtctgaggcctgggacccccccctcccaccccctaacccatgtttctcattagtgtctcccgggcctgtccccaactcctccccacccctcccccatctcctctttgaaagccagaacaagagagcgctcctctcccagataggaaaagggcctctaacaaggagaaattagtgtgcggcaaaaggcagttttctttgttctcagactaatggatggttccagagaaggaaatgaaatgtgctgggtggggccgggcctccggcggcccggctgctgttcccatgtccacatctctgaggcctgcaccccctctgtctagctcggggagtccagccccagtcccgcaggctccgtggctttgggcctcacgtgcagaccctgccatgcagacccatgcccccctcccccaggcagctccaagaaagctccctgactcgccccttcaggcctggcaagctgggggcccatcgccgtggggagtccctcccaccaccctcgccgcaggcagctgcagcccccagaggggaccacaagcccaaaaaggacaaaaatgggctggcctggaatggcccagaccccagcctcccctcctccctcccatcctcacccaggccaaggcccaggggctctgccaggacaccacatgggagggggctcaggcctcagcctcaagatcttcagctgtggcctctcgggctcggcagaagggacgccggatcaggggcctggtctccagcacctgcccgagtggccgtggccaggatggggtgcgcattccgtgtgctttgcttgtggctgtgcaggctgaggtctggagccaggcccagagctggcttcagggtggggccttgagaaggggaatgtgggacaggggcgatggtgcctggtctctgagtaagatgccaggtcccaggaactcaggcttcaggtgagaaggagcggtgtgtccaggcaccgctggccggcagccctgggctgaggcacagactcatttgtcaccttctggcggcggcagccctggccccggcctccaagcagttgaaaaagctggcgcctccttggtctctaggatccaggctccacagagcacatgactagccaggcccctggcttaagaaggtcgcctaagcctaagagaagacagtcccaggagaagctggccgggaccagccaggagctgggagccacaggaagcaaaagtcagccttttcttcaagggatttccctgtctcagagcagcctttgccccagggaaatgggctctgggctggctgcctgcaccggccatgtcgacccaggacccggacacctggtcttgggctgtgttcagccactttgccttctctggactcagtttccccgtctgagaaatgagagtcgaatgctacagtatctgcagtcgcttggatctggctgttgagttgacgggttccttgaaccccacaaaatccctctccaaccacaggacccttcggctcaccaagaacggggcccaggggagtcaggcctattcgctgcacttcctgccaaactttgcccccacaagcctggtcatcagccaggcagccctcccagtgcccaagggccaccaaccccagggaaacagggccagcacagaggggccttcctcccccacagagctcccatgacatagtctgctctgggcggaagagctttgctgccagccagggatgtccagaggtcggtgcagcccctatccctgctcaggagtgggctcagagtctagcaaatgctaaggcccctcaggctgggctctgaacgaggacctggactcagagccagacagggcagcctcagacccttctctggggctcctggaccttgggccataatttctgagcctcggtttccccatctaaggaacagatgtggtcgttccgccctctcagctggatgagactgtcctggaggatccaccccggaacagacagaatggtgtctctcaggatggtgctctgagagagggcagagtggatgccccactgccctagaccctcggtagacgtggggtctctggggcggggtctgtggctgtgactgaagtcggctttcccgttgatgtcttgatgctcctatctgtgcacttaccgtaggtagggacacgtgtccatgcaccacagacacacccacgacacctgatctcgtatcactagcttgcggccaggtcatgatgtggccccggaagctggccctgcgtgccatgagtgcgtcggtcatggagtccggagcccctgagccggcccctggtgacggcacagccctcacagctcaaacgcccacccccactcccaccatctgcaggtggtgaaaacaaaccccgtgtatctctcaataaaggtggccgaagggcctcgatgtggacttga

SEQ ID NO: 301550 - DNA, 4104 bp, Homo sapiens
tcaagctcgccccgcgcagcccgagccgggctgggcgctgtcctcgggggcctggggaaccgcgcggtttggagatcggaggcacctggaacccgtggcaagcgccgagccgggagacagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcgcgttcatcggtccccgcctgagacgcgcccactcctgcccggacttccagccccggaggcgccggacagagccgcggactccagcgcccaccatgcgcctcaacagctccgcgccgggaaccccgggcacgccggccgccgaccccttccagcgggcgcaggccggactggaggaggcgctgctggccccgggcttcggcaacgcttcgggcaacgcgtcggagcgcgtcctggcggcacccagcagcgagctggacgtgaacaccgacatctactccaaagtgctggtgaccgccgtgtacctggcgctcttcgtggtgggcacggtgggcaacacggtgacggcgttcacgctggcgcggaagaagtcgctgcagagcctgcagagcacggtgcattaccacctgggcagcctggcgctgtccgacctgctcaccctgctgctggccatgcccgtggagctgtacaacttcatctgggtgcaccacccctgggccttcggcgacgccggctgccgcggctactacttcctgcgcgacgcctgcacctacgccacggccctcaacgtggccagcctgagtgtggagcgctacctggccatctgccaccccttcaaggccaagaccctcatgtcccgaagccgcaccaagaagttcatcagcgccatctggctcgcctcggccctgctgacggtgcctatgctgttcaccatgggcgagcagaaccgcagcgccgacggccagcacgccggcggcctggtgtgcacccccaccatccacactgccaccgtcaaggtcgtcatacaggtcaacaccttcatgtccttcatattccccatggtggtcatctcggtcctgaacaccatcatcgccaacaagctgaccgtcatggtacgccaggcggccgagcagggccaagtgtgcacggtcgggggcgagcacagcacattcagcatggccatcgagcctggcagggtccaggccctgcggcacggcgtgcgcgtcctacgtgcagtggtcatcgcctttgtggtctgctggctgccctaccacgtgcggcgcctcatgttctgctacatctcggatgagcagtggactccgttcctctatgacttctaccactacttctacatggtgaccaacgcactcttctacgtcagctccaccatcaaccccatcctgtacaacctcgtctctgccaacttccgccacatcttcctggccacactggcctgcctctgcccggtgtggcggcgcaggaggaagaggccagccttctcgaggaaggccgacagcgtgtccagcaaccacaccctctccagcaatgccacccgcgagacgctgtactaggctgtgcgccccggaacgtgtccaggaggagcctggccatgggtccttgcccccgacagacagagcagcccccacccgggagccttgatgggggtcaggcagaggccagcctgcactggagtctgaggcctgggacccccccctcccaccccctaacccatgtttctcattagtgtctcccgggcctgtccccaactcctccccacccctcccccatctcctctttgaaagccagaacaagagagcgctcctctcccagataggaaaagggcctctaacaaggagaaattagtgtgcggcaaaaggcagttttctttgttctcagactaatggatggttccagagaaggaaatgaaatgtgctgggtggggccgggcctccggcggcccggctgctgttcccatgtccacatctctgaggcctgcaccccctctgtctagctcggggagtccagccccagtcccgcaggctccgtggctttgggcctcacgtgcagaccctgccatgcagacccatgcccccctcccccaggcagctccaagaaagctccctgactcgccccttcaggcctggcaagctgggggcccatcgccgtggggagtccctcccaccaccctcgccgcaggcagctgcagcccccagaggggaccacaagcccaaaaaggacaaaaatgggctggcctggaatggcccagaccccagcctcccctcctccctcccatcctcacccaggccaaggcccaggggctctgccaggacaccacatgggagggggctcaggcctcagcctcaagatcttcagctgtggcctctcgggctcggcagaagggacgccggatcaggggcctggtctccagcacctgcccgagtggccgtggccaggatggggtgcgcattccgtgtgctttgcttgtggctgtgcaggctgaggtctggagccaggcccagagctggcttcagggtggggccttgagaaggggaatgtgggacaggggcgatggtgcctggtctctgagtaagatgccaggtcccaggaactcaggcttcaggtgagaaggagcggtgtgtccaggcaccgctggccggcagccctgggctgaggcacagactcatttgtcaccttctggcggcggcagccctggccccggcctccaagcagttgaaaaagctggcgcctccttggtctctaggatccaggctccacagagcacatgactagccaggcccctggcttaagaaggtcgcctaagcctaagagaagacagtcccaggagaagctggccgggaccagccaggagctgggagccacaggaagcaaaagtcagccttttcttcaagggatttccctgtctcagagcagcctttgccccagggaaatgggctctgggctggctgcctgcaccggccatgtcgacccaggacccggacacctggtcttgggctgtgttcagccactttgccttctctggactcagtttccccgtctgagaaatgagagtcgaatgctacagtatctgcagtcgcttggatctggctgttgagttgacgggttccttgaaccccacaaaatccctctccaaccacaggacccttcggctcaccaagaacggggcccaggggagtcaggcctattcgctgcacttcctgccaaactttgcccccacaagcctggtcatcagccaggcagccctcccagtgcccaagggccaccaaccccagggaaacagggccagcacagaggggccttcctcccccacagagctcccatgacatagtctgctctgggcggaagagctttgctgccagccagggatgtccagaggtcggtgcagcccctatccctgctcaggagtgggctcagagtctagcaaatgctaaggcccctcaggctgggctctgaacgaggacctggactcagagccagacagggcagcctcagacccttctctggggctcctggaccttgggccataatttctgagcctcggtttccccatctaaggaacagatgtggtcgttccgccctctcagctggatgagactgtcctggaggatccaccccggaacagacagaatggtgtctctcaggatggtgctctgagagagggcagagtggatgccccactgccctagaccctcggtagacgtggggtctctggggcggggtctgtggctgtgactgaagtcggctttcccgttgatgtcttgatgctcctatctgtgcacttaccgtaggtagggacacgtgtccatgcaccacagacacacccacgacacctgatctcgtatcactagcttgcggccaggtcatgatgtggccccggaagctggccctgcgtgccatgagtgcgtcggtcatggagtccggagcccctgagccggcccctggtgacggcacagcccttaaagtaaaagccaccccatccacattggggggaaaaaacccgtgttttccaaaagggcccagggaaaaaa

SEQ ID NO: 301551 - DNA, 1389 bp, Homo sapiens
taatgtttgctgttgctttgtgttaggctataagctctatgaggcaggcaggctgctttgtccactagcatgccttaaatcagtatttatggactgtgttgattcctgctcctctgcttacttgctctctcgctgtcattcatttagtcatcaaatactgatttaaggcatgctagtggacaaagcagccactgccctgccctcatagagcttatagcctaacacaaagcaacagcaaacattaggcatttgttcataaaacctttcccacaaagacttacaggcaggaaaattaggtattaatcaaatcacagaacctcccaaatgctaagtgaggattttaccctttgagcatatcccattaaaagcctcagttttctcatctgtgaaaggggacggtacctgccttttcaggtgaaacctagtgagataatgtgtatgcagctcttagcacagtgtcccccacataattggtgcataagtttccagctgatgtaagaaaaatacagaaaccccaatctaaatctatctctgaaactctaattataacttaagtttttgttatcattagggcagtgtccccttaatgttgagttcctttgttgtgtaatagtttgatatttgcaattggttttgtacagatagtaaagaaacataccagccagtagaggtttcagtttgagagcattcatcttttttcccttactggaggtaggatggaatcaaaacacacaggccttctgaccaggcctggggagcccagcatggacagaattactattcagtaaagctcctgccccagtgagctgtttttaccccagaccacagcttataggagctgcttttacccacccattatttctagttgttagtcttgttcctaatgcacttgtccacatcgtatgtcattacaagttcttccccttctttaaccagagggcatagaattggggcttagtgtgtcctaaacaagctaaaagattccacctgtagaatcataaaatgagagtctcacacagtttcatgctactttttgtctcttcagcaaggaacggttgcctgggattgtcagtgaccaggcatgtctggatagcttcacacatacacataatgcccggttcacctcagcccacacatgttctagaagtagccacttgccaagtgtcagtgttcagtctaaacagcaaatgggttaaccacatgaacagcactggcccatgtgagaatggtgtgaaggcctcctttgtaccattttccatttctctaactcacatgtgtagtctcagcactgcagaggacagatttgtttgtgccctctgagactggttggttggttggttggttagttttgttttatgaatcctaaaatttgtcttggcctgtaaaaaa

SEQ ID NO: 301552 - DNA, 3002 bp, Homo sapiens
  misc_feature (2343)..(2343): n is a, c, g, or t
  misc_feature (3002)..(3002): n is a, c, g, or t
cgccgcgggaggcggacgagatgcgagcgcggccgcggccccggccgctctgggcgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtagagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacacattatgcacaatcgctgaganaatggaatcaacctgtgtccatcgatggatgaatggataaagaaaatgtagtaaacatatgcaatggatactattcagccttaaaaaagaatttctgtcatttgtgacaacatgaatcaacatatgcaatggatactattcagccttaaaaaagaatttctgtcatttgtgacaacatgaatcaacttggaggacatactaagtgaaaaaagccaggcacagaaagacacataccacatgatctcacttatatgtggaatcttaaaaagtcaaactcatagaagtagacagtagaatagttgttagaggctggaaagggacggggcgggtaggagatgcaggatggggagatgctgttcaaagggtacaaggttcagtcagacaaaagcagcaagtttctgagatctattgcatagtgtggtgactatagctaataataatatatcgtatatctcaaaactgctaagagtaaatttcaaatgtctcaccataaaaaacgttaaacaaggtgatggatatgttaagcttgacttagtcgttccatattgtatacatatattaaaatataacattgtaccccattaaatatttacaattatgatttgtatatatatttaataataataaaaatctaaataaaatattaaagaatgcctacn

SEQ ID NO: 301553 - DNA, 5902 bp, Homo sapiens
cgccgcgggaggcggacgagatgcgagcgcggccgcggccccggccgctctgggcgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtagagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggattcttcctgcttagcttgagggtgactatggagctgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctgggcttggcagcccgggtcatctgtacctctgcctcctttcccctccctcaggccgaaggaggagtcagggagagctgaactattagagctgcctgtgccttttgccatcccctcaacccagctatggttctctcgcaagggaagtccttgcaagctaattctttgacctgttgggagtgaggatgtctgggccactcaggggtcattcatggcctgggggatgtaccagcatctcccagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggccctatgcttccggcctcctgtccctcatccatagcacctccacatacctggccctgagccttggtgtgctgtatccatccatggggctgattgtatttaccttctacctcttggctgccttgtgaaggaattattcccatgagttggctgggaataagtgccaggatggaatgatgggtcagttgtatcagcacgtgtggcctgttcttctatgggttggacaacctcattttaactcagtctttaatctgagaggccacagtgcaattttattttatttttctcatgatgaggttttcttaacttaaaagaacatgtatataaacatgcttgcattatatttgtaaatttatgtgatggcaaagaaggagagcataggaaaccacacagacttgggcagggtacagacactcccacttggcatcattcacagcaagtcactggccagtggctggatctgtgaggggctctctcatgatagaaggctatggggatagatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgagcagaaaactggagctctggcctcagtgttacagctaaataatctttaattaaggcaagtcactttcttcttcttaaagctgttttctagtttgagaaatgatgggattttagcagccagtcttgaaggtctctttcagtatcaacattctaagatgctgggacttactgtgtcatcaaatgtgcggttaagattctctgggatattgatactgtttgtgtttttagttgggagatctgagagacctggctttggcaagagcagatgtcattccatatcacctttctcaatgaaagtctcattctatcctctctccaaacccgttttccaacatttgttaatagttacgtctctcctgatgtagcacttaagcttcatttagttattatttctttcttcactttgcacacatttgcatccacatattagggaagaggaatccataagtagctgaaatatctattctgtattattgtgttaacattgagaataagccttggaattagatatggggcaatgactgagccctgtctcacccatggattactccttactgtagggaatggcagtatggtagagggataaatagggggcggggagggatagtcatggatccaagaagtccttagaaatagtggcagggaacaggtgtggaagctcatgcctgtaattataaccttcagctactaagacaggtgtggtggctcacgcctgtaattataatcttcagttactaagacagagtccatgagagtgttaatgggacattttctttagataagatgttttatatgaagaaactgtatcaaagggggaagaaaatgtatttaacaggtgaatcaaatcaggaatcttgtctgagctactggaatgaagttcacaggtcttgaagaccaatattatttgtcaatatgtggggataacctgtagctgcattcatgaggtagcaaatagcagttttggcctgtggggtgaacagctaaacagtgttctggcatcagataacacggcacaaagggattgtgtctagctcttttggagaaaatttatgtccagtctcaggatctgtggacaataacggaaaactttgaatattcctgacaagttgccatattaggagtcagttctttacttctctgagattcccaggtcatccatgattttttttttaatttgagacaaagcctcactcttgttgcccaagctggaatgcaatggcaagatctcagttcactgcaatctctgcctctcaggttcaagccattctcctgcctcagcctccccagtagccgggattacaggcacccgccaccacacccggctaattttgtatttttagtagagacggggtttcaccatgttggccaggctggtctcgaactcctgaccttaggcgatccaccttcctcggcctcccacagtgctgggattacaagtgtgaagcactgtgcccggccagtcatccatgattttaatggggtccaaaggcctctttttctttgttaagtattcctggttgaaatttcttttcttttttttttttttttggagacagagtcttgctctatcacccaggctggagtgcagtggcacgatctctgctcactgcaagcttcgcctcccgggttcacgccattctcctgcctcagcctcccgagtagctgggattacaggcacctgccaccacgcccggctaatttctttttgtatttttagtagagacggggtttcacggtgttagccaggaaggtctcgatctcctgacctcgtgatcctcccgcctcggcctcccaaagtgctgggattacaggcgtgagccactgcccccggctgtggttgaaatttcttaagtgccttcctcacttcctaaccaccttctctgtttgggtttgtgcaacagtaat

SEQ ID NO: 301554 - DNA, 4972 bp, Homo sapiens
  misc_feature (4942)..(4942): n is a, c, g, or t
  misc_feature (4947)..(4947): n is a, c, g, or t
cgccgcgggaggcggacgagatgcgagcgcggccgcggccccggccgctctgggcgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtagagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggattcttcctgcttagcttgagggtgactatggagctgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctgggcttggcagcccgggtcatctgtacctctgcctcctttcccctccctcaggccgaaggaggagtcagggagagctgaactattagagctgcctgtgccttttgccatcccctcaacccagctatggttctctcgcaagggaagtccttgcaagctaattctttgacctgttgggagtgaggatgtctgggccactcaggggtcattcatggcctgggggatgtaccagcatctcccagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggccctatgcttccggcctcctgtccctcatccatagcacctccacatacctggccctgagccttggtgtgctgtatccatccatggggctgattgtatttaccttctacctcttggctgccttgtgaaggaattattcccatgagttggctgggaataagtgccaggatggaatgatgggtcagttgtatcagcacgtgtggcctgttcttctatgggttggacaacctcattttaactcagtctttaatctgagaggccacagtgcaattttattttatttttctcatgatgaggttttcttaacttaaaagaacatgtatataaacatgcttgcattatatttgtaaatttatgtgatggcaaagaaggagagcataggaaaccacacagacttgggcagggtacagacactcccacttggcatcattcacagcaagtcactggccagtggctggatctgtgaggggctctctcatgatagaaggctatggggatagatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgagcagaaaactggagctctggcctcagtgttacagctaaataatctttaattaaggcaagtcactttcttcttcttaaagctgttttctagtttgagaaatgatgggattttagcagccagtcttgaaggtctctttcagtatcaacattctaagatgctgggacttactgtgtcatcaaatgtgcggttaagattctctgggatattgatactgtttgtgtttttagttgggagatctgagagacctggctttggcaagagcagatgtcattccatatcacctttctcaatgaaagtctcattctatcctctctccaaacccgttttccaacatttgttaatagttacgtctctcctgatgtagcacttaagcttcatttagttattatttctttcttcactttgcacacatttgcatccacatattagggaagaggaatccataagtagctgaaatatctattctgtattattgtgttaacattgagaataagccttggaattagatatggggcaatgactgagccctgtctcacccatggattactccttactgtagggaatggcagtatggtagagggataaatagggggcggggagggatagtcatggatccaagaagtccttagaaatagtggcagggaacaggtgtggaagctcatgcctgtaattataaccttcagctactaagacaggtgtggtggctcacgcctgtaattataatcttcagttactaagacagagtccatgagagtgttaatgggacattttctttagataagatgttttatatgaagaaactgtatcaaagggggaagaaaatgtatttaacaggtgaatcaaatcaggaatcttgtctgagctactggaatgaagttcacaggtcttgaagaccaatattatttgtcaatatgtggggataacctgtagctgcattcatgcgnacccngggatcctctagaacgcctgcacca

SEQ ID NO: 301555 - DNA, 5385 bp, Homo sapiens
cgccgcgggaggcggacgagatgcgagcgcggccgcggccccggccgctctgggcgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtagagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgggccactcaggggtcattcatggcctgggggatgtaccagcatctcccagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggccctatgcttccggcctcctgtccctcatccatagcacctccacatacctggccctgagccttggtgtgctgtatccatccatggggctgattgtatttaccttctacctcttggctgccttgtgaaggaattattcccatgagttggctgggaataagtgccaggatggaatgatgggtcagttgtatcagcacgtgtggcctgttcttctatgggttggacaacctcattttaactcagtctttaatctgagaggccacagtgcaattttattttatttttctcatgatgaggttttcttaacttaaaagaacatgtatataaacatgcttgcattatatttgtaaatttatgtgatggcaaagaaggagagcataggaaaccacacagacttgggcagggtacagacactcccacttggcatcattcacagcaagtcactggccagtggctggatctgtgaggggctctctcatgatagaaggctatggggatagatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgagcagaaaactggagctctggcctcagtgttacagctaaataatctttaattaaggcaagtcactttcttcttcttaaagctgttttctagtttgagaaatgatgggattttagcagccagtcttgaaggtctctttcagtatcaacattctaagatgctgggacttactgtgtcatcaaatgtgcggttaagattctctgggatattgatactgtttgtgtttttagttgggagatctgagagacctggctttggcaagagcagatgtcattccatatcacctttctcaatgaaagtctcattctatcctctctccaaacccgttttccaacatttgttaatagttacgtctctcctgatgtagcacttaagcttcatttagttattatttctttcttcactttgcacacatttgcatccacatattagggaagaggaatccataagtagctgaaatatctattctgtattattgtgttaacattgagaataagccttggaattagatatggggcaatgactgagccctgtctcacccatggattactccttactgtagggaatggcagtatggtagagggataaatagggggcggggagggatagtcatggatccaagaagtccttagaaatagtggcagggaacaggtgtggaagctcatgcctgtaattataaccttcagctactaagacaggtgtggtggctcacgcctgtaattataatcttcagttactaagacagagtccatgagagtgttaatgggacattttctttagataagatgttttatatgaagaaactgtatcaaagggggaagaaaatgtatttaacaggtgaatcaaatcaggaatcttgtctgagctactggaatgaagttcacaggtcttgaagaccaatattatttgtcaatatgtggggataacctgtagctgcattcatgaggtagcaaatagcagttttggcctgtggggtgaacagctaaacagtgttctggcatcagataacacggcacaaagggattgtgtctagctcttttggagaaaatttatgtccagtctcaggatctgtggacaataacggaaaactttgaatattcctgacaagttgccatattaggagtcagttctttacttctctgagattcccaggtcatccatgattttttttttaatttgagacaaagcctcactcttgttgcccaagctggaatgcaatggcaagatctcagttcactgcaatctctgcctctcaggttcaagccattctcctgcctcagcctccccagtagccgggattacaggcacccgccaccacacccggctaattttgtatttttagtagagacggggtttcaccatgttggccaggctggtctcgaactcctgaccttaggcgatccaccttcctcggcctcccacagtgctgggattacaagtgtgaagcactgtgcccggccagtcatccatgattttaatggggtccaaaggcctctttttctttgttaagtattcctggttgaaatttcttttcttttttttttttttttggagacagagtcttgctctatcacccaggctggagtgcagtggcacgatctctgctcactgcaagcttcgcctcccgggttcacgccattctcctgcctcagcctcccgagtagctgggattacaggcacctgccaccacgcccggctaatttctttttgtatttttagtagagacggggtttcacggtgttagccaggaaggtctcgatctcctgacctcgtgatcctcccgcctcggcctcccaaagtgctgggattacaggcgtgagccactgcccccggctgtggttgaaatttcttaagtgccttcctcacttcctaaccaccttctctgtttgggtttgtgcaacagtaat

SEQ ID NO: 301556 - DNA, 6241 bp, Homo sapiens
cgccgcgggaggcggacgagatgcgagcgcggccgcggccccggccgctctgggcgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtagagctggaagtgcgtgacctccctgaagagttgtctctatccttcaatgccacctgcctcaacaatgaggtcatccctggcctcaagtcttgtatgggactcaagattggagacacggtgaggtgggctgggcagggcctttgtcctggagcatctgtgggcacccaaccccctttcttccttttgtagtgactaaaaatggcccccttccaccagaaaaaaaatatgggcaagaaaaatacgtttcctgaaagtcattctaagttagatgtaatggatccaccaatcttttcctctgaggcttctgttgcgtaagccatttctgttacgtgaacttcactctcaggaatttgaaaaacttacaatttggttacctttgtttgtgtatgcacagttgattgcaaaggaaaatatttctttaccttcagtccctcaccagtcgccagcctttccaaggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggattcttcctgcttagcttgagggtgactatggagctgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctgggcttggcagcccgggtcatctgtacctctgcctcctttcccctccctcaggccgaaggaggagtcagggagagctgaactattagagctgcctgtgccttttgccatcccctcaacccagctatggttctctcgcaagggaagtccttgcaagctaattctttgacctgttgggagtgaggatgtctgggccactcaggggtcattcatggcctgggggatgtaccagcatctcccagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggccctatgcttccggcctcctgtccctcatccatagcacctccacatacctggccctgagccttggtgtgctgtatccatccatggggctgattgtatttaccttctacctcttggctgccttgtgaaggaattattcccatgagttggctgggaataagtgccaggatggaatgatgggtcagttgtatcagcacgtgtggcctgttcttctatgggttggacaacctcattttaactcagtctttaatctgagaggccacagtgcaattttattttatttttctcatgatgaggttttcttaacttaaaagaacatgtatataaacatgcttgcattatatttgtaaatttatgtgatggcaaagaaggagagcataggaaaccacacagacttgggcagggtacagacactcccacttggcatcattcacagcaagtcactggccagtggctggatctgtgaggggctctctcatgatagaaggctatggggatagatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgagcagaaaactggagctctggcctcagtgttacagctaaataatctttaattaaggcaagtcactttcttcttcttaaagctgttttctagtttgagaaatgatgggattttagcagccagtcttgaaggtctctttcagtatcaacattctaagatgctgggacttactgtgtcatcaaatgtgcggttaagattctctgggatattgatactgtttgtgtttttagttgggagatctgagagacctggctttggcaagagcagatgtcattccatatcacctttctcaatgaaagtctcattctatcctctctccaaacccgttttccaacatttgttaatagttacgtctctcctgatgtagcacttaagcttcatttagttattatttctttcttcactttgcacacatttgcatccacatattagggaagaggaatccataagtagctgaaatatctattctgtattattgtgttaacattgagaataagccttggaattagatatggggcaatgactgagccctgtctcacccatggattactccttactgtagggaatggcagtatggtagagggataaatagggggcggggagggatagtcatggatccaagaagtccttagaaatagtggcagggaacaggtgtggaagctcatgcctgtaattataaccttcagctactaagacaggtgtggtggctcacgcctgtaattataatcttcagttactaagacagagtccatgagagtgttaatgggacattttctttagataagatgttttatatgaagaaactgtatcaaagggggaagaaaatgtatttaacaggtgaatcaaatcaggaatcttgtctgagctactggaatgaagttcacaggtcttgaagaccaatattatttgtcaatatgtggggataacctgtagctgcattcatgaggtagcaaatagcagttttggcctgtggggtgaacagctaaacagtgttctggcatcagataacacggcacaaagggattgtgtctagctcttttggagaaaatttatgtccagtctcaggatctgtggacaataacggaaaactttgaatattcctgacaagttgccatattaggagtcagttctttacttctctgagattcccaggtcatccatgattttttttttaatttgagacaaagcctcactcttgttgcccaagctggaatgcaatggcaagatctcagttcactgcaatctctgcctctcaggttcaagccattctcctgcctcagcctccccagtagccgggattacaggcacccgccaccacacccggctaattttgtatttttagtagagacggggtttcaccatgttggccaggctggtctcgaactcctgaccttaggcgatccaccttcctcggcctcccacagtgctgggattacaagtgtgaagcactgtgcccggccagtcatccatgattttaatggggtccaaaggcctctttttctttgttaagtattcctggttgaaatttcttttcttttttttttttttttggagacagagtcttgctctatcacccaggctggagtgcagtggcacgatctctgctcactgcaagcttcgcctcccgggttcacgccattctcctgcctcagcctcccgagtagctgggattacaggcacctgccaccacgcccggctaatttctttttgtatttttagtagagacggggtttcacggtgttagccaggaaggtctcgatctcctgacctcgtgatcctcccgcctcggcctcccaaagtgctgggattacaggcgtgagccactgcccccggctgtggttgaaatttcttaagtgccttcctcacttcctaaccaccttctctgtttgggtttgtgcaacagtaat

SEQ ID NO: 301557 - DNA, 2900 bp, Homo sapiens
cgccgcgggaggcggacgagatgcgagcgcggccgcggccccggccgctctgggcgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtagagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagtaagagacggggctgggcgttttctaaagtcattggtctgagactcttaagtggaagcagcagatgctttgggtggtcatgttcagccagtaccatcgtctttccattatcctctgttctggaaactgggagagatggtctcactatccccttgtccttcagcttccttcagcctcttagaaatagtggcaggatgtcattccatctcattctcttctttctcctcaaataaatggttacttccaggctgggcctggtggcgcgtgcctgtaatcccagcactttgagaggccaaggtgggcagatcacttgagctcaagagttcgagaccagcctgggcaacatggtgaaaccccgtctctattaataatataaaaattagccgggtgtggtggtgcatgcctgtaatcccagctattcgggaggctgaagcaggaggattgcttgaacccagtaggtagaggttgtagtgagctgagattgcaccctgctctgggtgacagagcaggactcggtctcaaaaataataataataataataataataataaaataaaataaaaggttacttccaaatc

SEQ ID NO: 301558 - DNA, 1684 bp, Homo sapiens
cgccgcgggaggcggacgagatgcgagcgcggccgcggccccggccgctctgggcgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtagagctggaagtgcgtgacctccctgaagagttgtctctatccttcaatgccacctgcctcaacaatgaggtcatccctggcctcaagtcttgtatgggactcaagattggagacacggtgaggtgggctgggcagggcctttgtcctggagcatctgtgggcacccaaccccctttcttccttttgtagtgactaaaaatggcccccttccaccagaaaaaaaatatgggcaagaaaaatacgtttcctgaaagtcattctaagttagatgtaatggatccaccaatcttttcctctgaggcttctgttgcgtaagccatttctgttacgtgaacttcactctcaggaatttgaaaaacttacaatttggttacctttgtttgtgtatgcacagttgattgcaaaggaaaatatttctttaccttcagtccctcaccagtcgccagcctttccaaggtaattaatacctttcttttgtaaaacgacacaagaaagtaaaatctaaaatgtaaaacactcca

SEQ ID NO: 301559 - DNA, 442 bp, Homo sapiens
gcggccgcggcaagtgtgaatgtggcagctgtgtctgtatccagccgggctcctatggggacacctgtgagaagtgccccacctgcccagatgcctgcacctttaagaagtgagtgtggagtctggagagagccgggaggctgggaggtaggagaggatcccctgactagaatccccagctctccaggtgtgtttcttgctcaccagagccttagggagaggagtccactccagccagatggctgtctctccttttgccaaaggctttgggcaagttggaatagagccaactgtgaaggagccaaagttgaacgagctggacttcgattgagaatgtcctctcctagggtgacatcctgactccctctgagctgggaggaaggctaaaccagtctgaggaacaatccagtgctaatgttctgattcagtgggagatgtgagg

SEQ ID NO: 301560 - DNA, 3667 bp, Homo sapiens
cagaaaaaactcagggcaaggttggccttggctcataagaccttttcaaactttattgagtcaatggttctagagaaagagaacacccatgaacgttccccaagttctcccaagggcgagaaggggaagagcaggctgcgccagggttcctggcgggcgtttctgaaaagcaaagatgccggaagccccaaaaagcccaccctagtgagtctgcctctaggacccgaagttctctccccagcagagactgacagccactgtgaggaacgggcggaggacaaagagggctatgtttttagcgatcactgggcaccgccacttgcctccacacctttgtcctccagtttagtttctccagaacacaggaggaaaagtgaaccgaccatcaagtgcacagccacccaggaaggcgacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaacctggctgct

SEQ ID NO: 301561 - DNA, 4258 bp, Homo sapiens
cagaaaaaactcagggcaaggttggccttggctcataagaccttttcaaactttattgagtcaatggttctagagaaagagaacacccatgaacgttccccaagttctcccaagggcgagaaggggaagagcaggctgcgccagggttcctggcgggcgtttctgaaaagcaaagatgccggaagccccaaaaagcccaccctagtgagtctgcctctaggacccgaagttctctccccagcagagactgacagccactgtgaggaacgggcggaggacaaagagggctatgtttttagcgatcactgggcaccgccacttgcctccacacctttgtcctccagtttagtttctccagaacacaggaggaaaagtgaaccgaccatcaagtgcacagccacccaggaaggcgacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaaggtaggcggacagcagccccacctcctcggctgcccggtccttaccctgctgacatcattcccttctctgaaccacaaagccaagccagctagccaccaggcctgaggggggcccactgccctttgcagctgtttgttcccaaaggttggtaataaggggccactggggaagcctgggtcagtatatggttgacattcttactctcaacaccttggctcccccagatcagggccattggtgacaatgcttgtttccccagggttccttcctgacaggcatctggggttggtgtagggatggagctgctttccccatttctacagagagccatgcccctgaaacatcacatgcctttgcacaggccacccccctcttcaggctgctgcaggaggccaggcccaggccagagaccccaggcagcctgagctcttggatgtggtcagctctccaggagcaagtcctgtgtggcaaaactgcctcctacggcggctctgaagcagagccctgggacggaccccatgctgtccccaacagctggggtggcactctgccctgggcacccatgaccctctgctgtctctccctgttcagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaacctggctgct

SEQ ID NO: 301562 - DNA, 145 bp, Homo sapiens
gcggccgcctactactactactgctcgaattcaagcttctaacgatgtacgaggacatggacagtcactcttgcactattccttctccaagccagaaaccacatttaatttcataaataaatttatgaaaagtaacctggctgct

SEQ ID NO: 301563 - DNA, 2946 bp, Homo sapiens
tagagagaggaaatgaggccagatgggcagcaagctttggatgctgtggtaaggagttttgactgtcactctgaagcagctctcaggcagaggaatgatgtgatttattgtagtttaccaaggaccgctcagggtattgtgcagagggaagaccagctggaggttcttgtgtcactccgtgaagtgtgggggcggcggaggggcagagatgggacctgcactggagccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaacctggctgct

SEQ ID NO: 301564 - DNA, 3256 bp, Homo sapiens
ggcttcgcgggaggagccccaggcccgcgagcgcaggcgccccgcctctccccgggcgctgcgggccaccggctcggccctgtgcggcgggatctcggggccgcacggagcgggaggccgggcgccatggcgagggccccgcagccccggcgcggccccgcggcgcccgggaacgccctgcgcgccctgctgcgctgcaacctgccccccggcgcccagcgcgtggtggtctccgccgtgctggcgctcctggttctcatcaacgtcgtactgatcttcctgctggccttccgctgagcggccgcgcagggcgccgcgccggggtgagtggcgcgggcgacggcactccagccgttgccacccgcggcctccgcactggtcgcggagggaaggcctccttccaccccatgtgctcactaccagggcctggtccgggggtgtcgccgagcgggtgcctgaggggcgtggtggcacgtgtgtcacagggtccttctgtcctctgtgccctgtggggagtgggggctgcgggggcgaggggggaggccaaaatggcgcgtctctgcgagtaaccgaggatgcggattcagctggggctccccggctgcttgtctggaaacggagtgcatgtgaccgctgggtgagcgacccgcgcttgcatctgtgtaggttgagtcagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaacctggctgct

SEQ ID NO: 301565 - DNA, 2144 bp, Homo sapiens
gcaggaggcagccacgcctctgcatgcctccagtcagccagtttgagcattagcagtgtgctgggcactgctgcagccctggggcaacacacagaaaactagccctgtcctgatgagctccttgcaatgggggaagaggatgccaacaggatattaagctctgctctgtgcttgccatttatggagaagagaggggctgtgcatctgatagtgaggatgtggtcaaagggcacagccccagaggaaagcagctccacacgtgggggctgcaggggatcctcaccctttctctgtctccagcctgcagcagccttccatctctgttctgccccagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaacctggctgct

SEQ ID NO: 301566 - DNA, 2111 bp, Homo sapiens
gcaggaggcagccacgcctctgcatgcctccagtcagccagtttgagcattagcagtgtgctgggcactgctgcagccctggggcaacacacagaaaactagccctgtcctgatgagctccttgcaatgggggaagaggatgccaacaggatattaagctctgctctgtgcttgccatttatggagaagagaggggctgtgcatctgatagtgaggatgtggtcaaagggcacagccccagaggaaagcagctccacacgtgggggctgcaggggatcctcaccctttctctgtctccagcctgcagcagccttccatctctgttctgccccagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaacctggctgct

SEQ ID NO: 301567 - DNA, 726 bp, Homo sapiens
ggcttcgcgggaggagccccaggcccgcgagcgcaggcgccccgcctctccccgggcgctgcgggccaccggctcggccctgtgcggcgggatctcggggccgcacggagcgggaggccgggcgccatggcgagggccccgcagccccggcgcggccccgcggcgcccgggaacgccctgcgcgccctgctgcgctgcaacctgccccccggcgcccagcgcgtggtggtctccgccgtgctggcgctcctggttctcatcaacgtcgtactgatcttcctgctggccttccgctgagcggccgcgcagggcgccgcgccggggtgagtggcgcgggcgacggcactccagccgttgccacccgcggcctccgcactggtcgcggagggaaggcctccttccaccccatgtgctcactaccagggcctggtccgggggtgtcgccgagcgggtgcctgaggggcgtggtggcacgtgtgtcacagggtccttctgtcctctgtgccctgtggggagtgggggctgcgggggcgaggggggaggccaaaatggcgcgtctctgcgagtaaccgaggatgcggattcagctggggctccccggctgcttgtctggaaacggagtgcatgtgaccgctgggtgagcgacccgcgcttgcatctgtgtaggttgagtcaggtgtgtggaagaccccgggcaccgctgcgcatgttacctgcagttgtttt

SEQ ID NO: 301568 - DNA, 2903 bp, Homo sapiens
ggcttcgcgggaggagccccaggcccgcgagcgcaggcgccccgcctctccccgggcgctgcgggccaccggctcggccctgtgcggcgggatctcggggccgcacggagcgggaggccgggcgccatggcgagggccccgcagccccggcgcggccccgcggcgcccgggaacgccctgcgcgccctgctgcgctgcaacctgccccccggcgcccagcgcgtggtggtctccgccgtgctggcgctcctggttctcatcaacgtcgtactgatcttcctgctggccttccgctgagcggccgcgcagggcgccgcgccgggctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaacctggctgct

SEQ ID NO: 301569 - DNA, 3250 bp, Homo sapiens
ccgcctgcccgtggctctctcggcagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggccccgggagtgggaaccatgacttacacctgaagaagttgaggcacggtcaagttattagccctggagatagcagagaggggacctggattccatctaagggggtctccagtcttcaaggaaggaatccaggtgcagtctccaaaaggcctggctcagggcgtccaagctgagggccgtccggcggggaggtcccaggccctggtgttcagatgctcctcctgccccagatcccctgggaaactgtccactccgcaccctaagcctttccccaagttgcatgttagccagcgggcgcgccacccatccccctgcttctgcccgctggggctggcaggagcaggcactggttcaggaactgcagcaagcgctccagcctctgtgccgggcacaagcagggtctaggaaggaggccaaatcggtattcggatcacactgacggcggctgcgggcgtcggagtcgtcattcctcggtccaggacttgcgtgggtggcgtggtggggggagctggccggccagtcctcagccctgcgccccgtacaccctgcggggcctccgaggcccggttcccgccgctgcggcgcagggcgcggggcgttgctccgagggatgcggggcactgaccggccacgcatggcctgcagctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaacctggctgct

SEQ ID NO: 301570 - DNA, 1443 bp, Homo sapiens
ggcttcgcgggaggagccccaggcccgcgagcgcaggcgccccgcctctccccgggcgctgcgggccaccggctcggccctgtgcggcgggatctcggggccgcacggagcgggaggccgggcgccatggcgagggccccgcagccccggcgcggccccgcggcgcccgggaacgccctgcgcgccctgctgcgctgcaacctgccccccggcgcccagcgcgtggtggtctccgccgtgctggcgctcctggttctcatcaacgtcgtactgatcttcctgctggccttccgctgagcggccgcgcagggcgccgcgccgggctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggtaccagagctgctctgccctgctgccccaagttgagcaagtggagggaggggagctgagggctgggagcagctgcccagaagacagg

SEQ ID NO: 301571 - DNA, 510 bp, Homo sapiens
cctggcctggcggcgacacctgggttccagcttccttacggaagagatgagctgcggctgctgttagggttagggccaggcctgttctcagtccgcgcacccgctccttgtccggagtagccgaagcctggggcttgcgggcccagcctgaggggagctgagggtgcccgcgggaaggcatctgggtcgcggcgaggaccctttcaggcgggcccaacactgccgggcgtttaatggggtttccccaattttctgctaggtagggccacccaggtttcaagtgagtagcaggctccgttccagaggtcttggaacaggtccaggttactcactcggatgtgcggcgtctggttggaaatggttgaatcccagaatggcagtgcaggatgggaagcacatttattgtgtgccatgtaccagttgctgtgccaagcgaattttctattacggaaaacaagccagctggcccgttttgcagaaaacttaagaaacaaagagagttgaagcgtc

SEQ ID NO: 301572 - DNA, 2850 bp, Homo sapiens
agcgggtcgccggaagtggggcgggactctattgtggcggtgaggaacaggaagccctgaagggtcaaaagaaatacaaaagcaaaggctattttctttttttttttctttctttcattccttccttcctctgtttctttctttcttcctttcatttttttttcttttttaagagcgagcggctctgcggtggcggtttggggtgggcgccgccgaggtgaggtcgtctcgcctcccgcgcgccggtagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301573 - DNA, 2729 bp, Homo sapiens
agcgggtcgccggaagtggggcgggactctattgtggcggtgaggaacaggaagccctgaagggtcaaaagaaatacaaaagcaaaggctattttctttttttttttctttctttcattccttccttcctctgtttctttctttcttcctttcatttttttttcttttttaagagcgagcggctctgcggtggcggtttggggtgggcgccgccgaggtgaggtcgtctcgcctcccgcgcgccggtagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301574 - DNA, 2126 bp, Homo sapiens
agcgggtcgccggaagtggggcgggactctattgtggcggtgaggaacaggaagccctgaagggtcaaaagaaatacaaaagcaaaggctattttctttttttttttctttctttcattccttccttcctctgtttctttctttcttcctttcatttttttttcttttttaagagcgagcggctctgcggtggcggtttggggtgggcgccgccgaggtgaggtcgtctcgcctcccgcgcgccggtagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcatttgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301575 - DNA, 1784 bp, Homo sapiens
agcgggtcgccggaagtggggcgggactctattgtggcggtgaggaacaggaagccctgaagggtcaaaagaaatacaaaagcaaaggctattttctttttttttttctttctttcattccttccttcctctgtttctttctttcttcctttcatttttttttcttttttaagagcgagcggctctgcggtggcggtttggggtgggcgccgccgaggtgaggtcgtctcgcctcccgcgcgccggtagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattcta

SEQ ID NO: 301576 - DNA, 2640 bp, Homo sapiens
agcgggtcgccggaagtggggcgggactctattgtggcgattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301577 - DNA, 3484 bp, Homo sapiens
aatataagactttgtttttcttgacggtcaggcagatttgaaaaccacgttctttatttgtgccaatttggactctaagtttggtggacaaagtgaattttgaaatggttttagttttccatgaattccctatttgaagaaattgaataaatcctttaaaaaataatgtaatgtttagtttgataattaaacttgagtcgctttggaaaacgtgagtaaaggaaagctgacagcatttgtttactctttctaaagtggaacacagtaaggacaaagtaagcattcctaatgtaagtcctctgcattcctacagggctcttcacagttagagcccgtatccctgatatccctgggctgtttgtcttttgatttgtttttaattaccctagcaaacaaaagggaaaaagaagagacttgtgaaaatttacctagacaataggaattagaagtcaacacaatctaattttctagcttctttgtctacttccagcaggtcagtaagttacaggtacttatcacctctttcttgcagaataaacagccattggactcttcaaacaaaaacgctgtctccatcaagtactgctttcgcaggataagtgaccatttttaatcagttgaaattaacggaaagtagcagttatttttgaaagatgacatcaattatataatatagtaaagagatttaatttttagtcctttgtttcttactgcacaaattgtatggcgtttgaatagaattcccatgatactgacacttcagcaaatacttgcttgatggctaccaatctctataacttacattgcacagtacctaggaatattcatgtgagttcattcctccctgctcagattcttcagctcctcgtggttggtttattcaattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301578 - DNA, 2978 bp, Homo sapiens
cctggcctggcggcgacacctgggttccagcttccttacggaagagatgagctgcggctgctgttagggttagggccaggcctgttctcagtccgcgcacccgctccttgtccggagtagccgaagcctggggcttgcgggcccagcctgaggggagctgagggtgcccgcgggaaggcatctgggtcgcggcgaggaccctttcaggcgggcccaacactgccgggcgtttaatggggtttccccaattttctgctagaatcttgccctgtcgctcaagctggggtgcagcggtgtgatcttggctcactgcaacctccgcctcccaggttcaagcgattctcctgcctcagcctcctgagtagctgggattacagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301579 - DNA, 2968 bp, Homo sapiens
agcgggtcgccggaagtggggcgggactctattgtggcggtgaggaacaggaagccctgaagggtcaaaagaaatacaaaagcaaaggctattttctttttttttttctttctttcattccttccttcctctgtttctttctttcttcctttcatttttttttcttttttaagagcgagcggctctgcggtggcggtttggggtgggcgccgccgaggtgaggtcgtctcgcctcccgcgcgccggtagaatcttgccctgtcgctcaagctggggtgcagcggtgtgatcttggctcactgcaacctccgcctcccaggttcaagcgattctcctgcctcagcctcctgagtagctgggattacagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301580 - DNA, 2881 bp, Homo sapiens
agcgggtcgccggaagtggggcgggactctattgtggcggtgaggaacaggaagccctgaagggtcaaaagaaatacaaaagcaaaggctattttctttttttttttctttctttcattccttccttcctctgtttctttctttcttcctttcatttttttttcttttttaagagcgagcggctctgcggtggcggtttggggtgggcgccgccgaggtgaggtcgtctcgcctcccgcgcgccggtagattcttcagctcctcgtggttggtttattcaattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301581 - DNA, 2991 bp, Homo sapiens
agcgggtcgccggaagtggggcgggactctattgtggcgaataaacagccattggactcttcaaacaaaaacgctgtctccatcaagtactgctttcgcaggataagtgaccatttttaatcagttgaaattaacggaaagtagcagttatttttgaaagatgacatcaattatataatatagtaaagagatttaatttttagtcctttgtttcttactgcacaaattgtatggcgtttgaatagaattcccatgatactgacacttcagcaaatacttgcttgatggctaccaatctctataacttacattgcacagtacctaggaatattcatgtgagttcattcctccctgctcagattcttcagctcctcgtggttggtttattcaattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301582 - DNA, 2919 bp, Homo sapiens
agcgggtcgccggaagtggggcgggactctattgtggcggtgaggaacaggaagccctgaagggtcaaaagaaatacaaaagcaaaggctattttctttttttttttctttctttcattccttccttcctctgtttctttctttcttcctttcatttttttttcttttttaagagcgagcggctctgcggtggcggtttggggtgggcgccgccgaggtgaggtcgtctcgcctcccgcgcgccggtagactggacttgaacactaagtcttcaatagctgagattctccatcttaatctacttggaggcaagagcagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301583 - DNA, 3385 bp, Homo sapiens
ggaaagaaaccagatgattaatacaggatgagaaaggagacacggttaataggggataagaaagggggaaattgagggttcggaatgtctctcccaaccattagagccctagaaagttcacgttttctctgccagagacatttaagaaattgttggctctggtttcataagaggttgttctgtagaacttgaggaatttttggcattttcacagagactgaacagttctgcttcagtaatgagcctctggctggagtcattgagtgctgctaaatcagaagtgtccaggttgtgggctttaggtgggagcaacagcgtctgtcagttgatttcatttctttctagtaattttcacaattcgctcttattgttacattaaactaaacctcagcaacagtagtattcaggctgagactattctcttgttctgaacgtttgggtttgttttttcagcttccatttctagctttactaaataaaaatgttgcatgaatattctcagcactggaatttgaagtaggaagaaagctgaagtcgacatgtctttgttttcaactaagatttagtgttttctggggaggagtatggtaaagttggtaagagtatgcatttttgatatcaggcctggatttggttctcagctctaccattcaccacctgtatcaccttagacaaataatctaactcctctggacctcaacttcatctgtaaacagataatatttctcatagggtcaatgatcatgtaaattagataatatccataaaaggaatataatacatgattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301584 - DNA, 2663 bp, Homo sapiens
tagaattttaattgcagttctcacttgaaatgattttttttgtttttgtttttgttttgtagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301585 - DNA, 2776 bp, Homo sapiens
gagtcagattagtattcaggaaagtacgtggaactgaagttgggagatctgttcttccagtctcactttctccattcatggtttgtgcaccttccctgctatacagactggacttgaacactaagtcttcaatagctgagattctccatcttaatctacttggaggcaagagcagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301586 - DNA, 1802 bp, Homo sapiens
agcgggtcgccggaagtggggcgggactctattgtggcggtgaggaacaggaagccctgaagggtcaaaagaaatacaaaagcaaaggctattttctttttttttttctttctttcattccttccttcctctgtttctttctttcttcctttcatttttttttcttttttaagagcgagcggctctgcggtggcggtttggggtgggcgccgccgaggtgaggtcgtctcgcctcccgcgcgccggtagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttgttatcgagctcgataaggccaaagtgctgactgacatgccgggtggaccaggagctggagtctgttatcttagcacgaatgctcatgaccttggtttagtgttaaacagtggagcaggtcctgagcgggcacggccaggcctggaggagcggccgcacaca

SEQ ID NO: 301587 - DNA, 1761 bp, Homo sapiens
agcgggtcgccggaagtggggcgggactctattgtggcggtgaggaacaggaagccctgaagggtcaaaagaaatacaaaagcaaaggctattttctttttttttttctttctttcattccttccttcctctgtttctttctttcttcctttcatttttttttcttttttaagagcgagcggctctgcggtggcggtttggggtgggcgccgccgaggtgaggtcgtctcgcctcccgcgcgccggtagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttgggggagggggaggaagaagaatctcttgaacccaaaaggtggaggttgcagtgagctgagaccacaccattgcactccagcctgggttacagagactatgtcttatataatagtggttga

SEQ ID NO: 301588 - DNA, 2770 bp, Homo sapiens
agcgggtcgccggaagtggggcgggactctattgtggcggtgaggaacaggaagccctgaagggtcaaaagaaatacaaaagcaaaggctattttctttttttttttctttctttcattccttccttcctctgtttctttctttcttcctttcatttttttttcttttttaagagcgagcggctctgcggtggcggtttggggtgggcgccgccgaggtgaggtcgtctcgcctcccgcgcgccggtagtgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301589 - DNA, 1329 bp, Homo sapiens
agcgggtcgccggaagtggggcgggactctattgtggcggtgaggaacaggaagccctgaagggtcaaaagaaatacaaaagcaaaggctattttctttttttttttctttctttcattccttccttcctctgtttctttctttcttcctttcatttttttttcttttttaagagcgagcggctctgcggtggcggtttggggtgggcgccgccgaggtgaggtcgtctcgcctcccgcgcgccggtagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagtcagctccgttctagggatcctctagat

SEQ ID NO: 301590 - DNA, 3296 bp, Homo sapiens
  misc_feature (1045)..(1045): n is a, c, g, or t
ggaaagaaaccagatgattaatacaggatgagaaaggagacacggttaataggggataagaaagggggaaattgagggttcggaatgtctctcccaaccattagagccctagaaagttcacgttttctctgccagagacatttaagaaattgttggctctggtttcataagaggttgttctgtagaacttgaggaatttttggcattttcacagagactgaacagttctgcttcagtaatgagcctctggctggagtcattgagtgctgctaaatcagaagtgtccaggttgtgggctttaggtgggagcaacagcgtctgtcagttgatttcatttctttctagtaattttcacaattcgctcttattgttacattaaactaaacctcagcaacagtagtattcaggctgagactattctcttgttctgaacgtttgggtttgttttttcagcttccatttctagctttactaaataaaaatgttgcatgaatattctcagcactggaatttgaagtaggaagaaagctgaagtcgacatgtctttgttttcaactaagatttagtgttttctggggaggagtatggtaaagttggtaagagtatgcatttttgatatcaggcctggatttggttctcagctctaccattcaccacctgtatcaccttagacaaataatctaactcctctggacctcaacttcatctgtaaacagataatatttctcatagggtcaatgatcatgtaaattagataatatccataaaaggaatataatacatgattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatgtttgacccttanactggtaactcacaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301591 - DNA, 2603 bp, Homo sapiens
  misc_feature (541)..(541): n is a, c, g, or t
agcgggtcgccggaagtggggcgggactctattgtggcgattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcanagagtggcaacagtgtgtgcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301592 - DNA, 2464 bp, Homo sapiens
  misc_feature (13)..(13): n is a, c, g, or t
  misc_feature (15)..(15): n is a, c, g, or t
  misc_feature (402)..(402): n is a, c, g, or t
caagaagaatgtnanaagggcggagaggggaagatccagaataatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcanagagtggcaacagtgtgtgcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301593 - DNA, 1075 bp, Homo sapiens
agcgggtcgccggaagtggggcgggactctattgtggcggtgaggaacaggaagccctgaagggtcaaaagaaatacaaaagcaaaggctattttctttttttttttctttctttcattccttccttcctctgtttctttctttcttcctttcatttttttttcttttttaagagcgagcggctctgcggtggcggtttggggtgggcgccgccgaggtgaggtcgtctcgcctcccgcgcgccggtagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccccttattttttttccggccccttccacaaggggaagcttcctttccccaa

SEQ ID NO: 301594 - DNA, 2034 bp, Homo sapiens
  misc_feature (12)..(13): n is a, c, g, or t
  misc_feature (52)..(52): n is a, c, g, or t
  misc_feature (64)..(64): n is a, c, g, or t
  misc_feature (76)..(76): n is a, c, g, or t
attcggcacagnngggcaaaaggggctgtgctccttggacactttgcacagncccagtggcttnctttctcctctnttagtgtggttaatgttcatctgcctgcatccctgagtcacccaagtgtaacctcagcctcctgagtggctgggattacagccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtaatgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301595 - DNA, 1228 bp, Homo sapiens
agcgggtcgccggaagtggggcgggactctattgtggcggtgaggaacaggaagccctgaagggtcaaaagaaatacaaaagcaaaggctattttctttttttttttctttctttcattccttccttcctctgtttctttctttcttcctttcatttttttttcttttttaagagcgagcggctctgcggtggcggtttggggtgggcgccgccgaggtgaggtcgtctcgcctcccgcgcgccggtagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcacacaaagaagtaagggcagttattggacaggtgttatttaaacattctattgtaaatgaatgtgttgtttggttctactgcattgtggagcatgcgggggaagagaactgacccagaactactctgtgctaattgttctgccagtatgggcgcatcagctccatcctgacaaacaagacatttaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaaca

SEQ ID NO: 301596 - DNA, 1213 bp, Homo sapiens
cctggcctggcggcgacacctgggttccagcttccttacggaagagatgagctgcggctgctgttagggttagggccaggcctgttctcagtccgcgcacccgctccttgtccggagtagccgaagcctggggcttgcgggcccagcctgaggggagctgagggtgcccgcgggaaggcatctgggtcgcggcgaggaccctttcaggcgggcccaacactgccgggcgtttaatggggtttccccaattttctgctagaatcttgccctgtcgctcaagctggggtgcagcggtgtgatcttggctcactgcaacctccgcctcccaggttcaagcgattctcctgcctcagcctcctgagtagctgggattacagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaacttccttgatgaggtttctcgacagcaggaactaatagaaaagcaacgaagagaagaagaactgaaagaactgaaggaatacagaaataacctcaagaaggttggaatttctcaagagaacaagaaggaagtggaaaagaaactgactgtgaagcctatagaaaccaagaacaagttctcccaggcgaagctgttggcaggagctgtgaagcataagagctcagagagtggcaacagtgtgaaaagactgaaaccggaccctgagccagatgacaagaatcaagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaactttctgaggcctagtttccggctaagggagcctcccagggtaatgggcggaagggccaaggtattgtccaaaaaact

SEQ ID NO: 301597 - DNA, 1209 bp, Homo sapiens
aaaagtataaagaaaagaaatagttagctttgcagggagtagtgcttgggaggtaataggtgcttctggagtgctgttgatgttctgttcctaagtagggtgctatggcttgagtttggtttgtctgaccctaccaagtctcatgttaaaatttcatccccagtgttggaggtgaggcctggtgggaagggttgtgggagtggatttctcatgagtggcttcgtattctgtaaggagtgagttcattaagagactggcacttcctctctcctttctctcgccatgtgatctctgcatatgtcatctcctgtctgccttccaccgtgagcagcctgaagccctcactggaagcagatactgctaccatgcttcttgtacagcctgcaaaaccgtgagccaaataagccgaacattctaagacactgggattacatgagtgttagcactctatgacttaatgagaagtaggttttttggagaaaaatgtactttcagtatgtatattatatatttcatggttatttttaaaactcgtgagcaatgctggatacacactaccaactattacttccctgactgagccaatttttctgtaaatgcatcacaaatgtgaaagataaggtaggcctgaattctggggaatgacaatggtgaaggaaaggcgagacaggtgcaaaagacactgcagaactcaggctcaaaatctcatccttaactccttccctcatcccaccatgttgaatcagatgtcaatagcaattttatatggcattttttaagcttgcaaaaagttataaacagaaaatgttcattttatcactccatcacagacgaaaaacatgaaattaagctaggaaacatgttcaggtgattagagtagatagaacatagactaaaaaccagtgaacttataaaaaaaaatcccatgatgtggacaaaaaaaaagaacttgtggctcctcactccaactcctgtgactctctcaccttacccccactgccttcaagttttttgtagaaagagaaattttgtatggattgagtttaagatgatgccagaatatcaaggtagaattattaaacacacaaaagctaaggtttggtactctgaaaaaaggtcagaattggtgatagaaaattagaagttacccatccatagaagggtaataaagccatgagagtgaaggaaaccagtgagagagaatattga

SEQ ID NO: 301598 - DNA, 616 bp, Homo sapiens
agacctacatgactacggtttgaaggaaaaagactttatttaatcctagtgattggaattggaattctcatttgagccagaagatttcttgagtggttttgttttctgtgataacttggtttatataagtaatccacattacttgggtgttagtggtaaagcaagtctttgccttgtacaacaaagataatttagtgattgatacattctgaataatctggtggttatgacttgacacatacaaaaaatgttagtggttgcagtccatctgttgctctgtaaaaagatttttgttattgtttgtttgttttgagaccaagtctcactcttattgcctaggctggaatgcagtggcatgatctctgctcactgcaaactctgcctcctggattcaagcaattctcctgcctcagcctcctgagtagctgggattacaggcatgcaccatcatacctggctaatttttgttttgttttgttttttctttttttttgagataaagtctcactatgtcacccagcctggagtgcaatggtgagatctcagctcactgcaacctccgccccccaggttcaagagcttctcttgcctcagtctcccgagtagctgagattaa

SEQ ID NO: 301599 - DNA, 2274 bp, Homo sapiens
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataacaagtatacataattaatggctccaagtatttgcggagttccacgtttgccagctaggatcaaatccccgtggtagctagccaatacttgatttttccagtgagtattttgctctgtacctaaatctgtgccacagaatcttctgtgtccctagattccacgagctttttaagactacaataagaggatacatgcttttacacttttacatgcacagtttgtaagtctgtgcagaattgccctgcatcattgaaaggaaaaagagaaggtgctgaaaagttacacaaacacaccatacccctgtgagctactgctaggaacataaagtaggccctggtttggtgagatggtgttaagcatacagaagaggagtaaggtgtagacagtgagggtaacctgagggactgtgagaggtcattactcatttccttctaggcagacacactgaaaggtgggtataggtaggagaccagagacaacccctttaggctgcgtggcattggccttcatctgggcatgaatgagacattaataggtggttctggctggaaaagtaggtaagagtacgttttctgatgggagaagataattggatatgattaaaggttggagaagatttgttcaacaaatctgtaatagacctgaagaatggtagaacctgagtgataagaaatgggtaagaaaatggaaggacttatcacccaagaaatgatacatgctacaaacttcc

SEQ ID NO: 301600 - DNA, 1417 bp, Homo sapiens
gctgcagctgcagcagctggagggcgaagtgaaggagacaccgttccgattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301601 - DNA, 1081 bp, Homo sapiens
gttgtggttcacctttttatatgtgtgtgtatatatacttatatataaaatacgtaaccaaaaggctgtttgagaacctcttgcatgtttaatacagtgtgataattccactgaatggatattctgtggttcattttaccaatccctgtatgggtatgggttggggaaaaaaacctgttaaaacttgcaagttttcagtggaacactaaagacccacttgagctgtggttttttatttaaatgtaatgctacaaatcagcctgtgccttagacattattacattgtctattctagatctactaatttaaaatatcttatagcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301602 - DNA, 832 bp, Homo sapiens
  misc_feature (688)..(688): n is a, c, g, or t
  misc_feature (716)..(716): n is a, c, g, or t
  misc_feature (736)..(736): n is a, c, g, or t
  misc_feature (743)..(743): n is a, c, g, or t
  misc_feature (772)..(772): n is a, c, g, or t
  misc_feature (781)..(781): n is a, c, g, or t
  misc_feature (785)..(785): n is a, c, g, or t
  misc_feature (787)..(787): n is a, c, g, or t
ggcagtcccaaaaagcctctcaggcacacaacccagcacagcaaggcagtcacaccaagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtccatgctggggccgcacttngggggtcacttttccgcacagttgtggnagatcttgcccttcgtaacntgcttgnctcggtccctggcctcgtttggctgcgcnaaatcgtgntccngntcctttgggagcggcctgcttgggggggtccccccgggggggccc

SEQ ID NO: 301603 - DNA, 1205 bp, Homo sapiens
gtgattttgaaacctaaagaaaagttggaagaatggtacaatgaacatcatatgtccttaccttgcattgaccaattattaacaatttattaacaattattaacatttactacatttattttatgtctgaaacttcacatacttttaaaaaaatgtatgttttgcagacatacagacatggcagcccctagcatgtgtatcctaagagtaagacatttttctttataagcacaataccattgtcgcatctaagaaaactaacattaatgtaataccaaatacatattcagatttacccccgttcccaaatgtgtctttattgtaggttttcctttctaggatcgaattatgattatgtctttagtctcttttcatcgggatagtatactcaacattatagtatattctagaacactttgaagttgttattaaaacatttctctgtgacttggtgccttagctagaatggtaacccagttcttctggtgtctcagatacttccaagcgccctctggtggccagcactagtaggtcagctgacaggctgaggaagtgacaggcaggctctggggatgactgtgaaagaaggcccagactgagtgacgtgccaggtacatcacggttttttgtttttgtgtttttttgtcttaataggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301604 - DNA, 715 bp, Homo sapiens
  misc_feature (699)..(699): n is a, c, g, or t
cccaccgacggacggaggcagcccacctgcaggaccggggcgctgtcggtccacgtggccgctctggagcagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacgcgccntcggggtaccgagctc

SEQ ID NO: 301605 - DNA, 952 bp, Homo sapiens
  misc_feature (880)..(882): n is a, c, g, or t
  misc_feature (889)..(889): n is a, c, g, or t
  misc_feature (898)..(898): n is a, c, g, or t
  misc_feature (901)..(901): n is a, c, g, or t
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccaggtaacattttgaaaattttagtattaattttattaatttatttttgtatttcaaaaaaagaaaacaaattacttttctttcaaaatagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcatgatgnnncccaaanttggaggancantatccgaaggttgcgaaaacctaccttcagtaacctggttggacttcggtc

SEQ ID NO: 301606 - DNA, 1032 bp, Homo sapiens
gtgattttgaaacctaaagaaaagttggaagaatggtacaatgaacatcatatgtccttaccttgcattgaccaattattaacaatttattaacaattattaacatttactacatttattttatgtctgaaacttcacatacttttaaaaaaatgtatgttttgcagacatacagacatggcagcccctagcatgtgtatcctaagagtaagacatttttctttataagcacaataccattgtcgcatctaagaaaactaacattaatgtaataccaaatacatattcagatttacccccgttcccaaatgtgtctttattgtaggttttcctttctaggatcgaattatgattatgtctttagtctcttttcatcgggatagtatactcaacattatagtatattctagaacactttgaagttgttattaaaacatttctctgtgacttggtgccttagctagaatggtaacccagttcttctggtgtctcagatacttccaagcgccctctggtggccagcactagtaggtcagctgacaggctgaggaagtgacaggcaggctctggggatgactgtgaaagaaggcccagactgagtgacgtgccaggtacatcacggttttttgtttttgtgtttttttgtcttaataggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactg

SEQ ID NO: 301607 - DNA, 469 bp, Homo sapiens
  misc_feature (23)..(23): n is a, c, g, or t
  misc_feature (25)..(25): n is a, c, g, or t
  misc_feature (27)..(27): n is a, c, g, or t
  misc_feature (58)..(58): n is a, c, g, or t
  misc_feature (79)..(79): n is a, c, g, or t
  misc_feature (85)..(85): n is a, c, g, or t
tggcttgcgggtttggttcttgncngngactcggtttaagaaacacactcgggcttgnatggaataccctatactcagnatctgnagcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactg

SEQ ID NO: 301608 - DNA, 571 bp, Homo sapiens
gttgtggttcacctttttatatgtgtgtgtatatatacttatatataaaatacgtaaccaaaaggctgtttgagaacctcttgcatgtttaatacagtgtgataattccactgaatggatattctgtggttcattttaccaatccctgtatgggtatgggttggggaaaaaaacctgttaaaacttgcaagttttcagtggaacactaaagacccacttgagctgtggttttttatttaaatgtaatgctacaaatcagcctgtgccttagacattattacattgtctattctagatctactaatttaaaatatcttatagcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgtgagtacttttgtggacttagaatgggggttttggttgtgggaatgagtctttgggtatactgaattatgttgaaaatttgacctgatttcacacagt

SEQ ID NO: 301609 - DNA, 615 bp, Homo sapiens
  misc_feature (558)..(558): n is a, c, g, or t
gtatcaacgcagagtgcccattatggccgggtgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgaatggggancagaaattgggagggatccattttatccagaaaagttttgtggaaagatcctttgaa

SEQ ID NO: 301610 - DNA, 704 bp, Homo sapiens
ttgttgttgcactaacttgggcaactaatgtgtttctaacaggcttttgtgactgattgtttgttctgcaaagcagttttcctagatggctgtccagttgcttcatgtgtccttgtcttgtagttcattgagctgacttttttactccctgttattgtattgctgatttttactccctggtcatactgcagtttatttaagtctgttttgtgctctcttgtgcagaagtgtgtgtaaatttttcccaatgacatcagtttgttctttttccagaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtgtaagtatttctttcataggatactgtgatgtgggccctcagaggatgattttgatgtctgtcatcttattgatctgggtgcaccctaaaggatttctcataacatttaaaaacaaaatcattcttggtcatttctagggtgccccttgaaagtttatagtagaagactgttagtctgacctttggtgctgagagagtaaatg

SEQ ID NO: 301611 - DNA, 1544 bp, Homo sapiens
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301612 - DNA, 1838 bp, Homo sapiens
  misc_feature (1838)..(1838): n is a, c, g, or t
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataaaaaaaaaggcgtgaggaggatgaagaggtgcggactggacaagaggaccccatggcccttccccaagcctccttcccctctgttcattgaccagccacagcccccttgctggccctcactcccactttatttctttattatttatttatttaattatctgagatggagtttcactcttgatgccctggctggagtgcaatggcgtgatcttggctcactgcaacctccacctccctggtgcaagtgattcttctgccttagcctcccgagtagctgagtacaggcatgtgcccn

SEQ ID NO: 301613 - DNA, 1371 bp, Homo sapiens
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactg

SEQ ID NO: 301614 - DNA, 1433 bp, Homo sapiens
  misc_feature (1402)..(1402): n is a, c, g, or t
  misc_feature (1405)..(1405): n is a, c, g, or t
  misc_feature (1408)..(1408): n is a, c, g, or t
  misc_feature (1418)..(1418): n is a, c, g, or t
  misc_feature (1425)..(1425): n is a, c, g, or t
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgaaaaaaaaaacaaaaaaaaaaaaaaaaaaanttntgngggcgcgccngggcccngagaaaaa

SEQ ID NO: 301615 - DNA, 1406 bp, Homo sapiens
  misc_feature (1375)..(1375): n is a, c, g, or t
  misc_feature (1378)..(1378): n is a, c, g, or t
  misc_feature (1381)..(1381): n is a, c, g, or t
  misc_feature (1391)..(1391): n is a, c, g, or t
  misc_feature (1398)..(1398): n is a, c, g, or t
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaaaaaaaaaaaacaaaaaaaaaaaaaaaaaaanttntgngggcgcgccngggcccngagaaaaa

SEQ ID NO: 301616 - DNA, 1505 bp, Homo sapiens
aaacgccaggctggtactggtctcgagttctataggatatcgcaggctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301617 - DNA, 1487 bp, Homo sapiens
gaccacgcgtcgcgacccacgcgtcgcgctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301618 - DNA, 1495 bp, Homo sapiens
  misc_feature (23)..(23): n is a, c, g, or t
ttcccccaaaaggttccattagngccttttggcaggctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301619 - DNA, 1486 bp, Homo sapiens
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301620 - DNA, 1469 bp, Homo sapiens
taagatggccgcgctgccccgcggccctcgcccctctctgcccgggatctccctttggccctttgaccccagcttaccgcacttcttgtccctcccgcagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301621 - DNA, 1428 bp, Homo sapiens
ggcagtcccaaaaagcctctcaggcacacaacccagcacagcaaggcagtcacaccaagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301622 - DNA, 1414 bp, Homo sapiens
tggcacgaggataacttttaatggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301623 - DNA, 1269 bp, Homo sapiens
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctgctggtgtgaagcttaactctctgtctggtagatgggaagagcataatgtgggcaaaggtggtcgcctggagtggaggctatcagtgaagaacttggatggttcagagattggtaaaattcatggagagaaggggttttccagaaagataaagggttcagagggttgatttaagctgtagggagggtaaaaaggggggcaaattattgtatggtgggcaaaattatggaaaggggattggagctagtttatagaagggggtgtatgattataatttg

SEQ ID NO: 301624 - DNA, 1347 bp, Homo sapiens
  misc_feature (19)..(19): n is a, c, g, or t
gactctagaggatcccgangcgcacgatgggcgccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301625 - DNA, 1282 bp, Homo sapiens
tagaggatccgcttatgtctggacccaccaagaggattgttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301626 - DNA, 1310 bp, Homo sapiens
ccccaatacaggccacgtggatctgccattgcttttcacgtgaatgcctaggagaggctggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301627 - DNA, 1489 bp, Homo sapiens
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatgcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301628 - DNA, 1603 bp, Homo sapiens
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtgctgtcttccttaggcttggcgtggtgatgcttgtgatcccagctactcaggaggctgaggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301629 - DNA, 1648 bp, Homo sapiens
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtgatatcacaatttctggctgtagtctctttattattttcacatcagctgtcttccttaggcttggcgtggtgatgcttgtgatcccagctactcaggaggctgaggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301630 - DNA, 1549 bp, Homo sapiens
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtcgatcggatcaatcacttttctagaggaagtagcagtccctcttgtgagagcgcaaggtcattacttgtgctcctaagggcgtggacgtgctttgtggaatgaatgagctggtgtaatgagctcagattgcctgcccttaagcagcacagcattggccgaggacttgagagtcacattacaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactg

SEQ ID NO: 301631 - DNA, 1632 bp, Homo sapiens
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccaggtaacattttgaaaattttagtattaattttattaatttatttttgtatttcaaaaaaagaaaacaaattacttttctttcaaaatagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301632 - DNA, 1145 bp, Homo sapiens
acgaatcagctctgtacctgaacattcgtgtctatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301633 - DNA, 1019 bp, Homo sapiens
cggacgcgtgggtcgacccacgcgtccgaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301634 - DNA, 1019 bp, Homo sapiens
gctagaggaccccgtctgcccccatcagaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301635 - DNA, 1390 bp, Homo sapiens
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacagggccaaatcaaagctgacaaggaataactttgcagtgggctacaggactggggacttccagctacacactaatgtcaatgatgggacagaatttggaggatcaatttatcagaaagtttgtgaagatcttgacacttcagtaaaccttgcttggacatcaggtaccaactgcactcgttttggcattgcagctaaatatcagttggatcccactgcttccatttctgcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatctagttaccaatgctgcagtcctgcagtcacctatacattatttaaatgtatttaactgttaaatgcgctacccaccaataatgaaatagacctttatgaaaactgtgcaattgtgtgcatgtttgtttttatgttcctttagaaaacattgactgttaccattgaatgagatggatcagtggatattaagatgaggttacaaattttgttaagttcagccattattacttttggtatcccagaacatgacaaattatgaataaaacaagtatacataa

SEQ ID NO: 301636 - DNA, 818 bp, Homo sapiens
  misc_feature (802)..(802): n is a, c, g, or t
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgatgggacgcgccntcggggtaccgagctc

SEQ ID NO: 301637 - DNA, 855 bp, Homo sapiens
  misc_feature (798)..(798): n is a, c, g, or t
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtcaatgaatggggancagaaattgggagggatccattttatccagaaaagttttgtggaaagatcctttgaa

SEQ ID NO: 301638 - DNA, 987 bp, Homo sapiens
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtgtaagtatttctttcataggatactgtgatgtgggccctcagaggatgattttgatgtctgtcatcttattgatctgggtgcaccctaaaggatttctcataacatttaaaaacaaaatcattcttggtcatttctagggtgccccttgaaagtttatagtagaagactgttagtctgacctttggtgctgagagagtaaatg

SEQ ID NO: 301639 - DNA, 1091 bp, Homo sapiens
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtgatatcacaatttctggctgtagtctctttattattttcacatcagctgtcttccttaggcttggcgtggtgatgcttgtgatcccagctactcaggaggctgaggaattttcaacgtccggttcatctaatacagacactggtaaagttactgggaccttggagaccaaatacaagtggtgtgagtatggtctgactttcacagaaaagtggaacactgataacactctgggaacagaaatcgcaattgaagaccagatttgtcaaggtttgaaactgacatttgatactaccttctcaccaaacacaggaaagaaaagtggtaaaatcaagtcttcttacaagagggagtgtataaaccttggttgtgatgttgactttgattttgctggacctgcaatccatggttcagctgtctttggttatgagggctggcttgctggctaccagatgacctttgacagtgccaaatcaaagctgacaaggaataactttgcagtgggctacaggactggggacttccagctacacactaatgtgtaagtatttctttcataggatactgtgatgtgggccctcagaggatgattttgatgtctgtcatcttattgatctgggtgcaccctaaaggatttctcataacatttaaaaacaaaatcattcttggtcatttctagggtgccccttgaaagtttatagtagaagactgttagtctgacctttggtgctgagagagtaaatg

SEQ ID NO: 301640 - DNA, 678 bp, Homo sapiens
agcgggggggcagcggcggggtcctgtctgggagaggacagggttgcggcgggcggaacggtgtctccttcacttcgccctccagctgctgcagctgcagcccgaccgcgagcgtgccaagcggcttcagcagctagcggagcggtggcggcggcccccctcaggacaccaccagattcccctcttcccgcggcctcgccatggcgacccacggacagacttgcgcgcgtccaatgtgtattcctccatcatatgctgaccttggcaaagctgccagagatattttcaacaaaggatttggttttgggttggtgaaactggatgtgaaaacaaagtcttgcagtggcgtggtgagtgttactgttgaataagttctattgaacctttataatttttcaacttgtaaaatggtcataactgaaagatgtctacctgttttgtcttaaagaagaggcagaagttaactttgttttaagagatttgcgtgtaacctgatttattttggccttgaatgtgatttctgattttcatgtggtctttcgtcatattatgtatgcacaaggaacttaggaaagaccagtcaaggtggtactctttactcgtaagattacacatttgaagccagggaacccattattagacttttttgtaaccctttgtcaaccaatagtcagcaga

SEQ ID NO: 301641 - DNA, 676 bp, Homo sapiens
cttttctagaggaagtagcagtccctcttgtgagagcgcaaggtcattacttgtgctcctaagggcgtggacgtgctttgtggaatgaatgagctggtgtaatgagctcagattgcctgcccttaagcagcacagcattggccgaggacttgagagtcacattagtaagtttgaagcgctatttgatatttagttgatgtagacatttgagtgaaacacacatggcagtattttttccaagtttcaatatttaaattcccagtattaaattctcttcccactccagggtgttggttttcccctcagcgaagatattaaaggacgtatcagggtaaagggcctagtcttaggtttcggttttatctaatttagttaaatcagctcatctcagtgaattttggcagatacataaatatccatacacacaaatacttgtttgattctttgtacttgtccagtcctaggaagtgaggctgtaggtaatagactgtttttccgttttgaaacgaattccccaagtttgtataatcatggttatctgttttagaaataattcgttggtggtatctcctttatgggtcgttatagttctattgtagctcctgaccgcataaaaaacattccaacaaatgggattgcttgaattttaatatcagcagtgggtcatgctcttgtt

SEQ ID NO: 301642 - DNA, 678 bp, Homo sapiens
gcatgccgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaataaaattgtttattttatactttaaaaaatttttaaattaaccttttatcattaaaccacatagactttatgacag

SEQ ID NO: 301643 - DNA, 649 bp, Homo sapiens
gcatgccgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcgagacggggcctcaatatgttgcccagtctagtctggaactcctgagcgttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaa

SEQ ID NO: 301644 - DNA, 513 bp, Homo sapiens
  misc_feature (40)..(42): n is a, c, g, or t
cgggagcgccaggtccgggtcagccgggttcggtcttttnnnggatgatgcggtttggtacacgtatgttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaa

SEQ ID NO: 301645 - DNA, 507 bp, Homo sapiens
  misc_feature (47)..(47): n is a, c, g, or t
tttattattatatttttttttttataatttttattattgttttttanagagttaaaaactagttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaa

SEQ ID NO: 301646 - DNA, 977 bp, Homo sapiens
  misc_feature (633)..(634): n is a, c, g, or t
  misc_feature (651)..(651): n is a, c, g, or t
  misc_feature (657)..(657): n is a, c, g, or t
  misc_feature (676)..(676): n is a, c, g, or t
  misc_feature (678)..(678): n is a, c, g, or t
  misc_feature (684)..(684): n is a, c, g, or t
gcatgccgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaaaaaaaaaaaaaaaaaaaaacttgtgtgtggnngcgcgcgcttggggccnctgganaaagtttttaaaaccttgngngtgggngcgcgcgggggccccagggggttaggggaaccggggcccaaaagcgcgggtgccaagaggagagagaccgcgggcgccatgagagacaagcggcgcggggcgtcttctctcaccaaatattacataaaaaaggcgcgcgcggggggggaacaccagagaggcgtgttcttgcgaacaaaactcccaaagagtggggggaccagagagggaccaatacacgggagacttatatcaacaggggagcgttaccaaggggaaacctcacatattaaaaatatacgccccggcgcgga

SEQ ID NO: 301647 - DNA, 575 bp, Homo sapiens
ggtgaaggaccataatatgaaaaagtagagcggggcggtagctgcagtgcctctcttaaggttggtcaaagaaaaagtgatgtatgaaaaagaggcaaaacaacaagaagaaaagattgaaaaaatgagagctgaagacggtgaaaattatgacattaaaaagcaggctggtcttcaactcctggcctccagtgatcctcccaccccagcctctcagagtcctgggatgataagcgcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaa

SEQ ID NO: 301648 - DNA, 372 bp, Homo sapiens
aatcgctctcctaaaatgaagcatgaggataagcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaa

SEQ ID NO: 301649 - DNA, 515 bp, Homo sapiens
gcatgccgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaa

SEQ ID NO: 301650 - DNA, 1066 bp, Homo sapiens
gcatgccgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagtaagcaaagacttctgtgtcatgtttaaattttttttttcaatccaatacatggaaagccaaaagtttaaatatttaacactgagaactagttggcagtatttcttattcacttgccctttataccgctatattttaaaataattaatggagtttaaattgtgttttgaattatgcctccagtaaaagtactgttttctagcatgtttgttcagtttattaaaatttagctagttaaatttatttaagttatgatagtaccagtattgtccagcaatgtcttgattatttggttttcatacataaagatcttttgagacattgaggatgagttgactgattaaaattttaaaagatctaatgtttcaaaagaatttgggatcttattaaaaggatcttgaattctttcacattcaaacctagatcagtttgagagggggaaaaaacctggtaatctatgtagtcccctcatactaacttggagctgaataacacttatacttgctggtataaatgccttgtgatacagaaggtagataaagcaggaaataataactgttaaaatactatctaagacaggaagcatcatttgtatttcttgacagtttaaatgcttttttctctcatgaatctagtagctgagaaagtaatagaaattgcttggaaaaaaataatgttggccgccaggtgcagtggctcatgcctgtaatcccagca

SEQ ID NO: 301651 - DNA, 552 bp, Homo sapiens
aataaactttttctgaggtttttatttaattaatgctggtagctttagaagactgttattcacttattttatgagaatatatacagtgaaacaaaaccaccagttatttcttcctttccttgtaaagaaggaacagaatgtgggaaacctgtggaattacaatatatttagatgaggcttgggattttttacttttaattttttagttattaacattaatggtttgtaatatttgagtaaataacaaagtactgaaacttgaaaaggataaacttaatttttattgtatttcattttaggaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaa

SEQ ID NO: 301652 - DNA, 585 bp, Homo sapiens
  misc_feature (241)..(242): n is a, c, g, or t
  misc_feature (259)..(259): n is a, c, g, or t
  misc_feature (265)..(265): n is a, c, g, or t
  misc_feature (284)..(284): n is a, c, g, or t
  misc_feature (286)..(286): n is a, c, g, or t
  misc_feature (292)..(292): n is a, c, g, or t
gcatgccgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaaaaaaaaaaaaaaaaaaaaacttgtgtgtggnngcgcgcgcttggggccnctgganaaagtttttaaaaccttgngngtgggngcgcgcgggggccccagggggttaggggaaccggggcccaaaagcgcgggtgccaagaggagagagaccgcgggcgccatgagagacaagcggcgcggggcgtcttctctcaccaaatattacataaaaaaggcgcgcgcggggggggaacaccagagaggcgtgttcttgcgaacaaaactcccaaagagtggggggaccagagagggaccaatacacgggagacttatatcaacaggggagcgttaccaaggggaaacctcacatattaaaaatatacgccccggcgcgga

SEQ ID NO: 301653 - DNA, 267 bp, Homo sapiens
aatcgctctcctaaaatgaagcatgaggataagcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcgtcgcagtgcacgcgcgtaaccagacatctt

SEQ ID NO: 301654 - DNA, 1175 bp, Homo sapiens
gcatgccgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaaaagagattagagaggttacactggcggacaaggtaacagctataaggggcgagctgggggtgctagtaggggtaggcgagggggggtgggggcttgtggggccgagggggggggctttgggcgccttttgttgaggggggggaaaaagttggacccctcccactctcctgcttgcttgtgggggttcggtgggtggacagtatatctttcattcatggagcggggtggcggttgttgcagggatggggggttccgcgggatatgtaagttggggcgggggtgtcggtagtggggcaggtaggtaaggggcgggtgtgggggtgttgtgagtaggtctccgcgtgggcggcggcattagatctgttgtggggcggggggggggggggccgggcggtcggagatgtgcatgagattgcgatggaggggcgtcgtgggcgtgtgttgctagcgtatgcggtaagaggatcaattgggttgttgttggggtgggggtgcgggtatgttcacacgactgcgtcgtatctggggctgcgggcgccttgcacgcgggggcgagagacgctcgggaggcag

SEQ ID NO: 301655 - DNA, 645 bp, Homo sapiens
  misc_feature (603)..(605): n is a, c, g, or t
  misc_feature (645)..(645): n is a, c, g, or t
gcatgccgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaannntggcctcgttggcctcagcggtggagctctgcggccaaan

SEQ ID NO: 301656 - DNA, 591 bp, Homo sapiens
gcatgccgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaataaaattgtttattttatactttaaaaaatttttaaattaaccttttatcattaaaccacatagactttatgacag

SEQ ID NO: 301657 - DNA, 614 bp, Homo sapiens
gcatgccgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactatgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaataaaattgtttattttatactttaaaaaatttttaaattaaccttttatcattaaaccacatagactttatgacag

SEQ ID NO: 301658 - DNA, 454 bp, Homo sapiens
gcatgccgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaatgaaaaagacttggtggaagcttaggagtaataaggagcacgctttagatactgaatagatacgattgagagcctcttatctcatagcatctggagaagat

SEQ ID NO: 301659 - DNA, 602 bp, Homo sapiens
gcatgccgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaa

SEQ ID NO: 301660 - DNA, 542 bp, Homo sapiens
gttagggattatgttgacaaggacttcctggtttcatggcttcttttcttggttttcgtcttcaatttgctggagtacattaagtaaatttctcaggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaa

SEQ ID NO: 301661 - DNA, 515 bp, Homo sapiens
  misc_feature (45)..(45): n is a, c, g, or t
  misc_feature (59)..(59): n is a, c, g, or t
  misc_feature (63)..(63): n is a, c, g, or t
  misc_feature (68)..(68): n is a, c, g, or t
cggggcgcccgacctggcccgccgtgtctggtctttttaccggcngctgggggtggaanaccnaattntgttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaa

SEQ ID NO: 301662 - DNA, 591 bp, Homo sapiens
  misc_feature (45)..(45): n is a, c, g, or t
  misc_feature (59)..(59): n is a, c, g, or t
  misc_feature (63)..(63): n is a, c, g, or t
  misc_feature (68)..(68): n is a, c, g, or t
cggggcgcccgacctggcccgccgtgtctggtctttttaccggcngctgggggtggaanaccnaattntgttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaataaaattgtttattttatactttaaaaaatttttaaattaaccttttatcattaaaccacatagactttatgacag

SEQ ID NO: 301663 - DNA, 403 bp, Homo sapiens
  misc_feature (30)..(30): n is a, c, g, or t
  misc_feature (36)..(37): n is a, c, g, or t
  misc_feature (52)..(52): n is a, c, g, or t
  misc_feature (59)..(59): n is a, c, g, or t
gggggggccgtctggaaggagttttggttntttttnngccaactacgagcangataccnacttgcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaa

SEQ ID NO: 301664 - DNA, 593 bp, Homo sapiens
aggtgcgcaagtttatttcagcctgcaaacgtgcttctgtggccctcagcgggacggagaaccaggcggttgcggcaaaaagagcttgggatttcaaggcaggattttctccaggcctagaaaggagaagcctctgcccagagaaaggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaa

SEQ ID NO: 301665 - DNA, 652 bp, Homo sapiens
gcatgccgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaagatgcggccaaataataaattgagttgcaaaaaaggaaagaactaatgag

SEQ ID NO: 301666 - DNA, 656 bp, Homo sapiens
gcatgccgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggttacatatatatttctttgtctaatttaatatgtcaaataaatgagttcatctaaacagatgcggccgaaaactgcacacccgtttttttttacgtattatacgctatt

SEQ ID NO: 301667 - DNA, 154 bp, Homo sapiens
tgcttccaggaatactactctgaggattatgaaccctcagtgtcactcagaggaaaagagtctagtgattgctgagcaatttctaccacaacggctcatgtatctgccaaccccaaaccatgattttactttaccaaaggcacacgtgctcatg

SEQ ID NO: 301668 - DNA, 2195 bp, Homo sapiens
ctcgcgtaggctgcaggctcggggagggagggcagcggcgccgcgtcgggagccgccgccgtcccggtcctcccgcccgcccgcccatccggtgcctcctgcagcccgcctgctgggcagggccggcgcggcccggccatggagtcctacgacatcatcgccaaccagcctgtggtcatcgacaacggttcgggggtgattaaagctggctttgcaggagaccagattcccaaatactgtttcccaaactatgtcgggcggccgaagcacatgcgggtgatggctggagccctggagggggacctcttcatcggaccaaaagcagaggagcaccgggggctgctgaccatccgctaccccatggagcacggcgtggtgcgagactggaacgacatggaacgcatctggcagtacgtctactccaaggatcagctgcagaccttctcggaggagcatcctgtgctcctcacggaggccccgctcaacccgagtaagaaccgggagaaggcggcagaggtgttctttgagaccttcaacgtgccggccctgttcatctccatgcaggctgtgctcagtctgtacgcaacaggacgcacgacaggagtggttctagactcaggggacggggtcactcatgctgtgcccatctatgagggctttgccatgcctcactccatcatgcgggtggacattgccggccgcgacgtctcccgctacctccgactcctgctgcgcaaggaaggggttgacttccatacctcggctgagtttgaggttgtccggacaatcaaagagcgagcgtgctacctgtccatcaacccacagaaggatgaggctctggagacggagaaggtgcagtacacgttgccagacggcagcacgcttgatgtggggcctgcacgattccgggcccccgagctgctgttccagccggaccttgtgggggatgagagtgaggggctccatgaggtggtggccttcgccatacacaagtccgacatggacctgcgccggacgctgttcgccaacatcgtgctctcaggtggctcaacgcttttcaaaggcttcggagaccgattactcagtgaagtgaagaagcttgccccaaaggatatcaaaatcaagatctcagccccgcaggaacggctgtactccacatggattggcggctccatcctggcctcgctggacacttttaagaagatgtgggtgtccaaaaaggagtatgaagaggatggctcccgtgctattcatcgcaaaactttctagtgcccaaggagggcggggcatgttgggagagggggagggaggggagacagagcctttaaccctttttggtcttggctcgtatactaggcttagggtcccctgcatgccctgaacccctgggtgggtggcacagcagtgcccccctgcagccttcccctctacacaggacatgcacacacaagtaacattgagctgcatggacaggagccttgagctggcgtgtgggaattgagcgccatgtcaggctgttgtgggtatccccctggcagggccagctaggcctgtggttccctgctccgactctcagggctgcctccctgagctccagggccagaatgcctggatgcctgggtagccagtttggggagtgggctgcaaggggcagccagcagctcccactggtgtgtcactgcatccattgccacctcctgttcgtgacctgacagggtgacacagcccctttcacactctgtcctcctatcttcctgggtagatgccctggtgtagggctgagtactgaatggtcttccatccccagcaagggggtgcagcccagggtcaggcccttcagagccagggcagaggacgcacggtggctagagccgctgcactatccttttcagagcacttcatccacttgctcctccctctaccctcggcaccctgggtgggaaagggttgatgctcatcatttattgaggggaagccacttaataaggagtcagacctaaaagggggtgggggacattttcttacctcacccaagaaagaggtcgtcacttttgctgtggccagggccccacctccctctctcagatatgtacaataatttaacacggttgcctgaaaaaaacttttgtaaatcattatagtaataattatggacaaggcccagtgtgtggctctgttttcttgtggctctctgt

SEQ ID NO: 301669 - DNA, 439 bp, Homo sapiens
ctagggttcccctttgtcttgggagtctctcgttttggtcttgttgagccacaagggggtgcagcccagggtcaggcccttcagagccagggcagaggacgcacggtggctagagccgctgcactatccttttcagagcacttcatccacttgctcctccctctaccctcggcaccctgggtgggaaagggttgatgctcatcatttattgaggggaagccacttaataaggagtcagacctaaaagggggtgggggacattttcttacctcacccaagaaagaggtcgtcacttttgctgtggccagggccccacctccctctctcagatatgtacaataatttaacacggttgcctgaaaaaaacttttgtaaatcattatagtaataattatggacaaggcccagtgtgtggctctgttttcttgtggctctctgt

SEQ ID NO: 301670 - DNA, 2155 bp, Homo sapiens
ggaaaagagaggaaaaaaggaacataggctaggtacgaggcctcgtgttacggtgctcctgcagcccgcctgctgggcagggccggcgcggcccggccatggagtcctacgacatcatcgccaaccagcctgtggtcatcgacaacggttcgggggtgattaaagctggctttgcaggagaccagattcccaaatactgtttcccaaactatgtcgggcggccgaagcacatgcgggtgatggctggagccctggagggggacctcttcatcggaccaaaagcagaggagcaccgggggctgctgaccatccgctaccccatggagcacggcgtggtgcgagactggaacgacatggaacgcatctggcagtacgtctactccaaggatcagctgcagaccttctcggaggagcatcctgtgctcctcacggaggccccgctcaacccgagtaagaaccgggagaaggcggcagaggtgttctttgagaccttcaacgtgccggccctgttcatctccatgcaggctgtgctcagtctgtacgcaacaggacgcacgacaggagtggttctagactcaggggacggggtcactcatgctgtgcccatctatgagggctttgccatgcctcactccatcatgcgggtggacattgccggccgcgacgtctcccgctacctccgactcctgctgcgcaaggaaggggttgacttccatacctcggctgagtttgaggttgtccggacaatcaaagagcgagcgtgctacctgtccatcaacccacagaaggatgaggctctggagacggagaaggtgcagtacacgttgccagacggcagcacgcttgatgtggggcctgcacgattccgggcccccgagctgctgttccagccggaccttgtgggggatgagagtgaggggctccatgaggtggtggccttcgccatacacaagtccgacatggacctgcgccggacgctgttcgccaacatcgtgctctcaggtggctcaacgcttttcaaaggcttcggagaccgattactcagtgaagtgaagaagcttgccccaaaggatatcaaaatcaagatctcagccccgcaggaacggctgtactccacatggattggcggctccatcctggcctcgctggacacttttaagaagatgtgggtgtccaaaaaggagtatgaagaggatggctcccgtgctattcatcgcaaaactttctagtgcccaaggagggcggggcatgttgggagagggggagggaggggagacagagcctttaaccctttttggtcttggctcgtatactaggcttagggtcccctgcatgccctgaacccctgggtgggtggcacagcagtgcccccctgcagccttcccctctacacaggacatgcacacacaagtaacattgagctgcatggacaggagccttgagctggcgtgtgggaattgagcgccatgtcaggctgttgtgggtatccccctggcagggccagctaggcctgtggttccctgctccgactctcagggctgcctccctgagctccagggccagaatgcctggatgcctgggtagccagtttggggagtgggctgcaaggggcagccagcagctcccactggtgtgtcactgcatccattgccacctcctgttcgtgacctgacagggtgacacagcccctttcacactctgtcctcctatcttcctgggtagatgccctggtgtagggctgagtactgaatggtcttccatccccagcaagggggtgcagcccagggtcaggcccttcagagccagggcagaggacgcacggtggctagagccgctgcactatccttttcagagcacttcatccacttgctcctccctctaccctcggcaccctgggtgggaaagggttgatgctcatcatttattgaggggaagccacttaataaggagtcagacctaaaagggggtgggggacattttcttacctcacccaagaaagaggtcgtcacttttgctgtggccagggccccacctccctctctcagatatgtacaataatttaacacggttgcctgaaaaaaacttttgtaaatcattatagtaataattatggacaaggcccagtgtgtggctctgttttcttgtggctctctgt

SEQ ID NO: 301671 - DNA, 2430 bp, Homo sapiens
ctcgcgtaggctgcaggctcggggagggagggcagcggcgccgcgtcgggagccgccgccgtcccggtcctcccgcccgcccgcccatccggtgcctcctgcagcccgcctgctgggcagggccggcgcggcccggccatggagtcctacgacatcatcgccaaccagcctgtggtcatcgacaacggttcgggggtgattaaagctggctttgcaggagaccagattcccaaatactgtttcccaaactatgtcgggcggccgaagcacatgcgggtgatggctggagccctggagggggacctcttcatcggaccaaaagcagaggagcaccgggggctgctgaccatccgctaccccatggagcacggcgtggtgcgagactggaacgacatggaacgcatctggcagtacgtctactccaaggatcagctgcagaccttctcggaggagcatcctgtgctcctcacggaggccccgctcaacccgagtaagaaccgggagaaggcggcagaggtgttctttgagaccttcaacgtgccggccctgttcatctccatgcaggctgtgctcagtctgtgagtgctccctaagcctggcctccctgagtcctgtcctccctgtgccgtcctgcttgccatgaccagggtctgacttccctggaaaaacagccccttgatgactgttcctctagggagtccctcgtgtcctctcttcagactagataatgcagatgtgccagggttcctcccctgggtgaggaggtccccgtgcctcagtggctgaggtgaggggatgctgacctggtgacaggtacgcaacaggacgcacgacaggagtggttctagactcaggggacggggtcactcatgctgtgcccatctatgagggctttgccatgcctcactccatcatgcgggtggacattgccggccgcgacgtctcccgctacctccgactcctgctgcgcaaggaaggggttgacttccatacctcggctgagtttgaggttgtccggacaatcaaagagcgagcgtgctacctgtccatcaacccacagaaggatgaggctctggagacggagaaggtgcagtacacgttgccagacggcagcacgcttgatgtggggcctgcacgattccgggcccccgagctgctgttccagccggaccttgtgggggatgagagtgaggggctccatgaggtggtggccttcgccatacacaagtccgacatggacctgcgccggacgctgttcgccaacatcgtgctctcaggtggctcaacgcttttcaaaggcttcggagaccgattactcagtgaagtgaagaagcttgccccaaaggatatcaaaatcaagatctcagccccgcaggaacggctgtactccacatggattggcggctccatcctggcctcgctggacacttttaagaagatgtgggtgtccaaaaaggagtatgaagaggatggctcccgtgctattcatcgcaaaactttctagtgcccaaggagggcggggcatgttgggagagggggagggaggggagacagagcctttaaccctttttggtcttggctcgtatactaggcttagggtcccctgcatgccctgaacccctgggtgggtggcacagcagtgcccccctgcagccttcccctctacacaggacatgcacacacaagtaacattgagctgcatggacaggagccttgagctggcgtgtgggaattgagcgccatgtcaggctgttgtgggtatccccctggcagggccagctaggcctgtggttccctgctccgactctcagggctgcctccctgagctccagggccagaatgcctggatgcctgggtagccagtttggggagtgggctgcaaggggcagccagcagctcccactggtgtgtcactgcatccattgccacctcctgttcgtgacctgacagggtgacacagcccctttcacactctgtcctcctatcttcctgggtagatgccctggtgtagggctgagtactgaatggtcttccatccccagcaagggggtgcagcccagggtcaggcccttcagagccagggcagaggacgcacggtggctagagccgctgcactatccttttcagagcacttcatccacttgctcctccctctaccctcggcaccctgggtgggaaagggttgatgctcatcatttattgaggggaagccacttaataaggagtcagacctaaaagggggtgggggacattttcttacctcacccaagaaagaggtcgtcacttttgctgtggccagggccccacctccctctctcagatatgtacaataatttaacacggttgcctgaaaaaaacttttgtaaatcattatagtaataattatggacaaggcccagtgtgtggctctgttttcttgtggctctctgt

SEQ ID NO: 301672 - DNA, 2041 bp, Homo sapiens
ctcgcgtaggctgcaggctcggggagggagggcagcggcgccgcgtcgggagccgccgccgtcccggtcctcccgcccgcccgcccatccggtgcctcctgcagcccgcctgctgggcagggccggcgcggcccggccatggagtcctacgacatcatcgccaaccagcctgtggtcatcgacaacggttcgggggtgattaaagctggctttgcaggagaccagattcccaaatactgtttcccaaactatgtcgggcggccgaagcacatgcgggtgatggctggagccctggagggggacctcttcatcggaccaaaagcagaggagcaccgggggctgctgaccatccgctaccccatggagcacggcgtggtgcgagactggaacgacatggaacgcatctggcagtacgtctactccaaggatcagctgcagaccttctcggaggagcatcctgtgctcctcacggaggccccgctcaacccgagtaagaaccgggagaaggcggcagaggtgttctttgagaccttcaacgtgccggccctgttcatctccatgcaggctgtgctcagtctcgcaaggaaggggttgacttccatacctcggctgagtttgaggttgtccggacaatcaaagagcgagcgtgctacctgtccatcaacccacagaaggatgaggctctggagacggagaaggtgcagtacacgttgccagacggcagcacgcttgatgtggggcctgcacgattccgggcccccgagctgctgttccagccggaccttgtgggggatgagagtgaggggctccatgaggtggtggccttcgccatacacaagtccgacatggacctgcgccggacgctgttcgccaacatcgtgctctcaggtggctcaacgcttttcaaaggcttcggagaccgattactcagtgaagtgaagaagcttgccccaaaggatatcaaaatcaagatctcagccccgcaggaacggctgtactccacatggattggcggctccatcctggcctcgctggacacttttaagaagatgtgggtgtccaaaaaggagtatgaagaggatggctcccgtgctattcatcgcaaaactttctagtgcccaaggagggcggggcatgttgggagagggggagggaggggagacagagcctttaaccctttttggtcttggctcgtatactaggcttagggtcccctgcatgccctgaacccctgggtgggtggcacagcagtgcccccctgcagccttcccctctacacaggacatgcacacacaagtaacattgagctgcatggacaggagccttgagctggcgtgtgggaattgagcgccatgtcaggctgttgtgggtatccccctggcagggccagctaggcctgtggttccctgctccgactctcagggctgcctccctgagctccagggccagaatgcctggatgcctgggtagccagtttggggagtgggctgcaaggggcagccagcagctcccactggtgtgtcactgcatccattgccacctcctgttcgtgacctgacagggtgacacagcccctttcacactctgtcctcctatcttcctgggtagatgccctggtgtagggctgagtactgaatggtcttccatccccagcaagggggtgcagcccagggtcaggcccttcagagccagggcagaggacgcacggtggctagagccgctgcactatccttttcagagcacttcatccacttgctcctccctctaccctcggcaccctgggtgggaaagggttgatgctcatcatttattgaggggaagccacttaataaggagtcagacctaaaagggggtgggggacattttcttacctcacccaagaaagaggtcgtcacttttgctgtggccagggccccacctccctctctcagatatgtacaataatttaacacggttgcctgaaaaaaacttttgtaaatcattatagtaataattatggacaaggcccagtgtgtggctctgttttcttgtggctctctgt

SEQ ID NO: 301673 - DNA, 2268 bp, Homo sapiens
  misc_feature (2126)..(2126): n is a, c, g, or t
  misc_feature (2130)..(2130): n is a, c, g, or t
ctcgcgtaggctgcaggctcggggagggagggcagcggcgccgcgtcgggagccgccgccgtcccggtcctcccgcccgcccgcccatccggtgcctcctgcagcccgcctgctgggcagggccggcgcggcccggccatggagtcctacgacatcatcgccaaccagcctgtggtcatcgacaacggttcgggggtgattaaagctggctttgcaggagaccagattcccaaatactgtttcccaaactatgtcgggcggccgaagcacatgcgggtgatggctggagccctggagggggacctcttcatcggaccaaaagcagaggagcaccgggggctgctgaccatccgctaccccatggagcacggcgtggtgcgagactggaacgacatggaacgcatctggcagtacgtctactccaaggatcagctgcagaccttctcggaggagcatcctgtgctcctcacggaggccccgctcaacccgagtaagaaccgggagaaggcggcagaggtgttctttgagaccttcaacgtgccggccctgttcatctccatgcaggctgtgctcagtctgtacgcaacaggacgcacgacaggagtggttctagactcaggggacggggtcactcatgctgtgcccatctatgagggctttgccatgcctcactccatcatgcgggtggacattgccggccgcgacgtctcccgctacctccgactcctgctgcgcaaggaaggggttgacttccatacctcggctgagtttgaggttgtccggacaatcaaagagcgagcgtgctacctgtccatcaacccacagaaggatgaggctctggagacggagaaggtgcagtacacgttgccagacggcagcacgcttgatgtggggcctgcacgattccgggcccccgagctgctgttccagccggaccttgtgggggatgagagtgaggggctccatgaggtggtggccttcgccatacacaagtccgacatggacctgcgccggacgctgttcgccaacatcgtgctctcaggtggctcaacgcttttcaaaggcttcggagaccgattactcagtgaagtgaagaagcttgccccaaaggatatcaaaatcaagatctcagccccgcaggaacggctgtactccacatggattggcggctccatcctggcctcgctggacacttttaagaagatgtgggtgtccaaaaaggagtatgaagaggatggctcccgtgctattcatcgcaaaactttctagtgcccaaggagggcggggcatgttgggagagggggagggaggggagacagagcctttaaccctttttggtcttggctcgtatactaggcttagggtcccctgcatgccctgaacccctgggtgggtggcacagcagtgcccccctgcagccttcccctctacacaggacatgcacacacaagtaacattgagctgcatggacaggagccttgagctggcgtgtgggaattgagcgccatgtcaggctgttgtgggtatccccctggcagggccagctaggcctgtggttccctgctccgactctcagggctgcctccctgagctccagggccagaatgcctggatgcctgggtagccagtttggggagtgggctgcaaggggcagccagcagctcccactggtgtgtcactgcatccattgccacctcctgttcgtgacctgacagggtgacacagcccctttcacactctgtcctcctatcttcctgggtagatgccctggtgtagggctgagtactgaatggtcttccatccccagcaagggggtgcagcccagggtcaggcccttcagagccagggcagaggacgcacggtggctagagccgctgcactatccttttcagagcacttcatccacttgctcctccctctaccctcggcaccctgggtgggaaagggttgatgctcatcatttattgaggggaagccacttaataaggagtcagacctaaaagggggtgggggacattttcttacctcacccaagaaagaggtcgtcacttttgctgtggccagggccccacctccctctctcagatatgtacaataatttaacacggttgcctgaaaaaacttgnatcntttggatacttggccggaacaaaaaaggggggcgctaagattcctggggccagtatcgtcccttcttgcagggccataggcggttaacaacggcggtacgcggggagcggggcgtgagcaccggggggcacccaaaag

SEQ ID NO: 301674 - DNA, 1647 bp, Homo sapiens
cgtacaaggaccgccccatctcagactgccttcttcctgcagcgaacagaagctgcaaagtcgagttgcaggagcgcatcaaggcggaggagcagcggcgtgctgatgtgcaggataggctggagcgtaccatgcgggcaatgcatatgaccaaggaggccctggaacacctggcaagcaagctagaccacatcacagtagcagactccgcccctgaggaagctccgcccagagccccgcaggacgtgagaggcagctccaccatcacgcaggtggattcccgccccaaagtccactcaagagaacccaccccatgccctgtccagtacatgagaggcccgaacacaggggaaactccaacctgctccgcggggccttgtacgcgtatctcagccccgcaggaacggctgtactccacatggattgggtgaggcggggctcaagggagggctctgggaggagaccactttaccctggatgctcctcccattgttggcctaggccacgtggaggtgggtggatttccctcccaaattagggaaatgcaactctgagcacccaggaaggtggttggctccctgacaggtccacagcaatactatccctccatccccacagcggctccatcctggcctcgctggacacttttaagaagatgtgggtgtccaaaaaggagtatgaagaggatggctcccgtgctattcatcgcaaaactttctagtgcccaaggagggcggggcatgttgggagagggggagggaggggagacagagcctttaaccctttttggtcttggctcgtatactaggcttagggtcccctgcatgccctgaacccctgggtgggtggcacagcagtgcccccctgcagccttcccctctacacaggacatgcacacacaagtaacattgagctgcatggacaggagccttgagctggcgtgtgggaattgagcgccatgtcaggctgttgtgggtatccccctggcagggccagctaggcctgtggttccctgctccgactctcagggctgcctccctgagctccagggccagaatgcctggatgcctgggtagccagtttggggagtgggctgcaaggggcagccagcagctcccactggtgtgtcactgcatccattgccacctcctgttcgtgacctgacagggtgacacagcccctttcacactctgtcctcctatcttcctgggtagatgccctggtgtagggctgagtactgaatggtcttccatccccagcaagggggtgcagcccagggtcaggcccttcagagccagggcagaggacgcacggtggctagagccgctgcactatccttttcagagcacttcatccacttgctcctccctctaccctcggcaccctgggtgggaaagggttgatgctcatcatttattgaggggaagccacttaataaggagtcagacctaaaagggggtgggggacattttcttacctcacccaagaaagaggtcgtcacttttgctgtggccagggccccacctccctctctcagatatgtacaataatttaacacggttgcctgaaaaaaacttttgtaaatcattatagtaataattatggacaaggcccagtgtgtggctctgttttcttgtggctctctgt

SEQ ID NO: 301675 - DNA, 928 bp, Homo sapiens
  misc_feature (28)..(28): n is a, c, g, or t
  misc_feature (33)..(33): n is a, c, g, or t
taacgaattcaggctaggtacgaggccngtggntgggagggaggggagacagagcctttaaccctttttggtcttggctcgtatactaggcttagggtcccctgcatgccctgaacccctgggtgggtggcacagcagtgcccccctgcagccttcccctctacacaggacatgcacacacaagtaacattgagctgcatggacaggagccttgagctggcgtgtgggaattgagcgccatgtcaggctgttgtgggtatccccctggcagggccagctaggcctgtggttccctgctccgactctcagggctgcctccctgagctccagggccagaatgcctggatgcctgggtagccagtttggggagtgggctgcaaggggcagccagcagctcccactggtgtgtcactgcatccattgccacctcctgttcgtgacctgacagggtgacacagcccctttcacactctgtcctcctatcttcctgggtagatgccctggtgtagggctgagtactgaatggtcttccatccccagcaagggggtgcagcccagggtcaggcccttcagagccagggcagaggacgcacggtggctagagccgctgcactatccttttcagagcacttcatccacttgctcctccctctaccctcggcaccctgggtgggaaagggttgatgctcatcatttattgaggggaagccacttaataaggagtcagacctaaaagggggtgggggacattttcttacctcacccaagaaagaggtcgtcacttttgctgtggccagggccccacctccctctctcagatatgtacaataatttaacacggttgcctgaaaaaaacttttgtaaatcattatagtaataattatggacaaggcccagtgtgtggctctgttttcttgtggctctctgt

SEQ ID NO: 301676 - DNA, 2153 bp, Homo sapiens
ctcgcgtaggctgcaggctcggggagggagggcagcggcgccgcgtcgggagccgccgccgtcccggtcctcccgcccgcccgcccatccggtgcctcctgcagcccgcctgctgggcagggccggcgcggcccggccatggagtcctacgacatcatcgccaaccagcctgtggtcatcgacaacggttcgggggtgattaaagctggctttgcaggagaccagattcccaaatactgtttcccaaactatgtcgggcggccgaagcacatgcgggtgatggctggagccctggagggggacctcttcatcggaccaaaagcagaggagcaccgggggctgctgaccatccgctaccccatggagcacggcgtggtgcgagactggaacgacatggaacgcatctggcagtacgtctactccaaggatcagctgcagaccttctcggaggagcatcctgtgctcctcacggaggccccgctcaacccgagtaagaaccgggagaaggcggcagaggtgttctttgagaccttcaacgtgccggccctgttcatctccatgcaggctgtgctcagtctgtacgcaacaggacgcacgacaggagtggttctagactcaggggacggggtcactcatgctgtgcccatctatgagggctttgccatgcctcactccatcatgcgggtggacattgccggccgcgacgtctcccgctacctccgactcctgctgcgcaaggaaggggttgacttccatacctcggctgagtttgaggttgtccggacaatcaaagagcgagcgtgctacctgtccatcaacccacagaaggatgaggctctggagacggagaaggtgcagtacacgttgccagacggcagcacgcttgatgtggggcctgcacgattccgggcccccgagctgctgttccagccggaccttgtgggggatgagagtgaggggctccatgaggtggtggccttcgccatacacaagtccgacatggacctgcgccggacgctgttcgccaacatcgtgctctcaggtggctcaacgcttttcaaaggcttcggagaccgattactcagtgaagtgaagaagcttgccccaaaggatatcaaaatcaagatctcagccccgcaggaacggctgtactccacatggattggcggctccatcctggcctcgctggacacttttaagaagatgtgggtgtccaaaaaggagtatgaagaggatggctcccgtgctattcatcgcaaaactttctagtgcccaaggagggcggggcatgttgggagagggggagggaggggagacagagcctttaaccctttttggtcttggctcgtatactaggcttagggtcccctgcatgccctgaacccctgggtgggtggcacagcagtgcccccctgcagccttcccctctacacaggacatgcacacacaagtaacattgagctgcatggacaggagccttgagctggcgtgtgggaattgagcgccatgtcaggctgttgtgggtatccccctggcagggccagctaggcctgtggttccctgctccgactctcagggctgcctccctgagctccagggccagaatgcctggatgcctgggtagccagtttggggagtgggctgcaaggggcagccagcagctcccactggtgtgtcactgcatccattgccacctcctgttcgtgacctgacagggtgacacagcccctttcacactctgtcctcctatcttcctgggtagatgccctggtgtagggctgagtactgaatggtcttccatccccagcaagggggtgcagcccagggtcaggcccttcagagccagggcagaggacgcacggtggctagagccgctgcactatccttttcagagcacttcatccacttgctcctccctctaccctcggcaccctgggtgggaaagggttgatgctcatcatttattgaggggaagccacttaataaggagtcagacctaaaagggggtgggggacattttcttaccccacctccctctctcagatatgtacaataatttaacacggttgcctgaaaaaaacttttgtaaatcattatagtaataattatggacaaggcccagtgtgtggctctgttttcttgtggctctctgt

SEQ ID NO: 301677 - DNA, 1739 bp, Homo sapiens
  misc_feature (1738)..(1738): n is a, c, g, or t
ctcgcgtaggctgcaggctcggggagggagggcagcggcgccgcgtcgggagccgccgccgtcccggtcctcccgcccgcccgcccatccggtgcctcctgcagcccgcctgctgggcagggccggcgcggcccggccatggagtcctacgacatcatcgccaaccagcctgtggtcatcgacaacggttcgggggtgattaaagctggctttgcaggagaccagattcccaaatactgtttcccaaactatgtcgggcggccgaagcacatgcgggtgatggctggagccctggagggggacctcttcatcggaccaaaagcagaggagcaccgggggctgctgaccatccgctaccccatggagcacggcgtggtgcgagactggaacgacatggaacgcatctggcagtacgtctactccaaggatcagctgcagaccttctcggaggagcatcctgtgctcctcacggaggccccgctcaacccgagtaagaaccgggagaaggcggcagaggtgttctttgagaccttcaacgtgccggccctgttcatctccatgcaggctgtgctcagtctgtacgcaacaggacgcacgacaggagtggttctagactcaggggacggggtcactcatgctgtgcccatctatgagggctttgccatgcctcactccatcatgcgggtggacattgccggccgcgacgtctcccgctacctccgactcctgctgcgcaaggaaggggttgacttccatacctcggctgagtttgaggttgtccggacaatcaaagagcgagcgtgctacctgtccatcaacccacagaaggatgaggctctggagacggagaaggtgcagtacacgttgccagacggcagcacgcttgatgtggggcctgcacgattccgggcccccgagctgctgttccagccggaccttgtgggggatgagagtgaggggctccatgaggtggtggccttcgccatacacaagtccgacatggacctgcgccggacgctgttcgccaacatcgtgctctcaggtggctcaacgcttttcaaaggcttcggagaccgattactcagtgaagtgaagaagcttgccccaaaggatatcaaaatcaagatctcagccccgcaggaacggctgtactccacatggattggcggctccatcctggcctcgctggacacttttaagaagatgtgggtgtccaaaaaggagtatgaagaggatggctcccgtgctattcatcgcaaaactttctagtgcccaaggagggcggggcatgttgggagagggggagggaggggagacagagcctttaaccctttttggtcttggctcgtatactaggcttagggtcccctgcatgccctgaacccctgggtgggtggcacagcagtgcccccctgcagccttcccctctacacaggacatgcacacacaagtaacattgagctgcatggacaggagccttgagctggcgtgtgggaattgagcgccatgtcaggctgttgtgggtatccccctggcagggccagctaggcctgtggttccctgctccgactctcagggctgcctccctgagctccagggccagaatgcctggatgcctgggtagccagtttggggagtgggctgcaaggggcagccagcagctcccactggtgtgtcactgctgtgctagccacccaggggttccaggagcttgacaggggtacccctagagcctagnt

SEQ ID NO: 301678 - DNA, 1654 bp, Homo sapiens
ctcgcgtaggctgcaggctcggggagggagggcagcggcgccgcgtcgggagccgccgccgtcccggtcctcccgcccgcccgcccatccggtgcctcctgcagcccgcctgctgggcagggccggcgcggcccggccatggagtcctacgacatcatcgccaaccagcctgtggtcatcgacaacggttcgggggtgattaaagctggctttgcaggagaccagattcccaaatactgtttcccaaactatgtcgggcggccgaagcacatgcgggtgatggctggagccctggagggggacctcttcatcggaccaaaagcagaggagcaccgggggctgctgaccatccgctaccccatggagcacggcgtggtgcgagactggaacgacatggaacgcatctggcagtacgtctactccaaggatcagctgcagaccttctcggaggagcatcctgtgctcctcacggaggccccgctcaacccgagtaagaaccgggagaaggcggcagaggtgttctttgagaccttcaacgtgccggccctgttcatctccatgcaggctgtgctcagtctgtacgcaacaggacgcacgacaggagtggttctagactcaggggacggggtcactcatgctgtgcccatctatgagggctttgccatgcctcactccatcatgcgggtggacattgccggccgcgacgtctcccgctacctccgactcctgctgcgcaaggaaggggttgacttccatacctcggctgagtttgaggttgtccggacaatcaaagagcgagcgtgctacctgtccatcaacccacagaaggatgaggctctggagacggagaaggtgcagtacacgttgccagacggcagcacgcttgatgtggggcctgcacgattccgggcccccgagctgctgttccagccggaccttgtgggggatgagagtgaggggctccatgaggtggtggccttcgccatacacaagtccgacatggacctgcgccggacgctgttcgccaacatcgtgctctcaggtggctcaacgcttttcaaaggcttcggagaccgattactcagtgaagtgaagaagcttgccccaaaggatatcaaaatcaagatctcagccccgcaggaacggctgtactccacatggattggcggctccatcctggcctcgctggacacttttaagaagatgtgggtgtccaaaaaggagtatgaagaggatggctcccgtgctattcatcgcaaaactttctagtgcccaaggagggcggggcatgttgggagaggccagggcagaggacgcacggtggctagagccgctgcactatccttttcagagcacttcatccacttgctcctccctctaccctcggcaccctgggtgggaaagggttgatgctcatcatttattgaggggaagccacttaataaggagtcagacctaaaagggggtgggggacattttcttacctcacccaagaaagaggtcgtcacttttgctgtggccagggccccacctccctctctcagatatgtacaataatttaacacggttgcctgaaaaaaacttttgtaaatcattatagtaataattatggacaaggcccagtgtgtggctctgttttcttgtggctctctgt

SEQ ID NO: 301679 - DNA, 1493 bp, Homo sapiens
ctcgcgtaggctgcaggctcggggagggagggcagcggcgccgcgtcgggagccgccgccgtcccggtcctcccgcccgcccgcccatccggtgcctcctgcagcccgcctgctgggcagggccggcgcggcccggccatggagtcctacgacatcatcgccaaccagcctgtggtcatcgacaacggttcgggggtgattaaagctggctttgcaggagaccagattcccaaatactgtttcccaaactatgtcgggcggccgaagcacatgcgggtgatggctggagccctggagggggacctcttcatcggaccaaaagcagaggagcaccgggggctgctgaccatccgctaccccatggagcacggcgtggtgcgagactggaacgacatggaacgcatctggcagtacgtctactccaaggatcagctgcagaccttctcggaggagcatcctgtgctcctcacggaggccccgctcaacccgagtaagaaccgggagaaggcggcagaggtgttctttgagaccttcaacgtgccggccctgttcatctccatgcaggctgtgctcagtctgtacgcaacaggacgcacgacaggagtggttctagactcaggggacggggtcactcatgctgtgcccatctatgagggctttgccatgcctcactccatcatgcgggtggacattgccggccgcgacgtctcccgctacctccgactcctgctgcgcaaggaaggggttgacttccatacctcggctgagtttgaggttgtccggacaatcaaagagcgagcgtgctacctgtccatcaacccacagaaggatgaggctctggagacggagaaggtgcagtacacgttgccagacggcagcacgcttgatgtggggcctgcacgattccgggcccccgagctgctgttccagccggaccttgtgggggatgagagtgaggggctccatgaggtggtggccttcgccatacacaagtccgacatggacctgcgccggacgctgttcgccaacatcgtgctctcaggtggctcaacgcttttcaaaggcttcggagaccgattactcagtgaagtgaagaagcttgccccaaaggatatcaaaatcaagatctcagccccgcaggaacggctgtactccacatggattggcggctccatcctggcctcgctggacacttttaagaagatgtgggtgtccaaaaaggagtatgaagaggatggctcccgtgctattcatcgcaaaactttctagtgcccaaggagggcggggcatgttgggagaggggggtgggggacattttcttacctcacccaagaaagaggtcgtcacttttgctgtggccagggccccacctccctctctcagatatgtacaataatttaacacggttgcctgaaaaaaacttttgtaaatcattatagtaataattatggacaaggcccagtgtgtggctctgttttcttgtggctctctgt

SEQ ID NO: 301680 - DNA, 1356 bp, Homo sapiens
ctcgcgtaggctgcaggctcggggagggagggcagcggcgccgcgtcgggagccgccgccgtcccggtcctcccgcccgcccgcccatccggtgcctcctgcagcccgcctgctgggcagggccggcgcggcccggccatggagtcctacgacatcatcgccaaccagcctgtggtcatcgacaacggttcgggggtgattaaagctggctttgcaggagaccagattcccaaatactgtttcccaaactatgtcgggcggccgaagcacatgcgggtgatggctggagccctggagggggacctcttcatcggaccaaaagcagaggagcaccgggggctgctgaccatccgctaccccatggagcacggcgtggtgcgagactggaacgacatggaacgcatctggcagtacgtctactccaaggatcagctgcagaccttctcggaggagcatcctgtgctcctcacggaggccccgctcaacccgagtaagaaccgggagaaggcggcagaggtgttctttgagaccttcaacgtgccggccctgttcatctccatgcaggctgtgctcagtctgtacgcaacaggacgcacgacaggagtggttctagactcaggggacggggtcactcatgctgtgcccatctatgagggctttgccatgcctcactccatcatgcgggtggacattgccggccgcgacgtctcccgctacctccgactcctgctgcgcaaggaaggggttgacttccatacctcggctgagtttgaggttgtccggacaatcaaagagcgagcgtgctacctgtccatcaacccacagaaggatgaggctctggagacggagaaggtgcagtacacgttgccagacggcagcacgcttgatgtggggcctgcacgattccgggcccccgagctgctgttccagccggaccttgtgggggatgagagtgaggggctccatgaggtggtggccttcgccatacacaagtccgacatggacctgcgccggacgctgttcgccaacatcgtgctctcaggtggctcaacgcttttcaaaggcttcggagaccgattactcagtgaagtgaagaagcttgccccaaaggatatcaaaatcaagatctcagccccgcaggaacggctgtactccacatggattggcggctccatcctggcctcgctggacacttttaagaagatgtgggtgtccaaaaaggagtatgaagaggatggctcccgtgctattcatcgcaaaactttctagtgcccaaggagggcggggcatgttgggagaggacctgaaccctgggtgggtgggtgcccggaaagcgggtgcagcggggcctgtacg

SEQ ID NO: 301681 - DNA, 1774 bp, Homo sapiens
ctcgcgtaggctgcaggctcggggagggagggcagcggcgccgcgtcgggagccgccgccgtcccggtcctcccgcccgcccgcccatccggtgcctcctgcagcccgcctgctgggcagggccggcgcggcccggccatggagtcctacgacatcatcgccaaccagcctgtggtcatcgacaacggttcgggggtgattaaagctggctttgcaggagaccagattcccaaatactgtttcccaaactatgtcgggcggccgaagcacatgcgggtgatggctggagccctggagggggacctcttcatcggaccaaaagcagaggagcaccgggggctgctgaccatccgctaccccatggagcacggcgtggtgcgagactggaacgacatggaacgcatctggcagtacgtctactccaaggatcagctgcagaccttctcggaggagcatcctgtgctcctcacggaggccccgctcaacccgagtaagaaccgggagaaggcggcagaggtgttctttgagaccttcaacgtgccggccctgttcatctccatgcaggctgtgctcagtctgtacgcaacaggacgcacgacaggagtggttctagactcaggggacggggtcactcatgctgtgcccatctatgagggctttgccatgcctcactccatcatgcgggtggacattgccggccgcgacgtctcccgctacctccgactcctgctgcgcaaggaaggggttgacttccatacctcggctgagtttgaggttgtccggacaatcaaagagcgagcgtgctacctgtccatcaacccacagaaggatgaggctctggagacggagaaggtgcagtacacgttgccagacggcagcacgcttgatgtggggcctgcacgattccgggcccccgagctgctgttccagccggaccttgtgggggatgagagtgaggggctccatgaggtggtggccttcgccatacacaagtccgacatggacctgcgccggacgctgttcgccaacatcgtgctctcaggtggctcaacgcttttcaaaggcttcggagaccgattactcagtgaagtgaagaagcttgccccaaaggatatcaaaatcaagatctcagccccgcaggaacggctgtactccacatggattgggtgaggcggggctcaagggagggctctgggaggagaccactttaccctggatgctcctcccattgttggcctaggccacgtggaggtgggtggatttccctcccaaattagggaaatgcaactctgagcacccaggaaggtggttggctccctgacaggtccacagcaatactatccctccatccccacagcggctccatcctggcctcgctggacacttttaagaagatgtgggtgtccaaaaaggagtatgaagaggatggctcccgtgctattcatcgcaaaactttctagtgcccaaggagggcggggcatgttgggagaggccttgtacgcgtacaaggccccgcaggcacaagaaaagtagctgtgatctaggtctgcactaaagctgcctttcctggcactcagaagtgcccttccagtgcctaactgcagaagggtggcctcagcctcctcctcctcctccttggattcctcctcacggatctgcaccagcaactgaaagaggtttggggctggcccttcaccagccccggtaagccacagctgccttaggattggcccgatgtggtaggcccggcaatgactgctctaggagggcatgg

SEQ ID NO: 301682 - DNA, 1377 bp, Homo sapiens
ctcgcgtaggctgcaggctcggggagggagggcagcggcgccgcgtcgggagccgccgccgtcccggtcctcccgcccgcccgcccatccggtgcctcctgcagcccgcctgctgggcagggccggcgcggcccggccatggagtcctacgacatcatcgccaaccagcctgtggtcatcgacaacggttcgggggtgattaaagctggctttgcaggagaccagattcccaaatactgtttcccaaactatgtcgggcggccgaagcacatgcgggtgatggctggagccctggagggggacctcttcatcggaccaaaagcagaggagcaccgggggctgctgaccatccgctaccccatggagcacggcgtggtgcgagactggaacgacatggaacgcatctggcagtacgtctactccaaggatcagctgcagaccttctcggaggagcatcctgtgctcctcacggaggccccgctcaacccgagtaagaaccgggagaaggcggcagaggtgttctttgagaccttcaacgtgccggccctgttcatctccatgcaggctgtgctcagtctgtacgcaacaggacgcacgacaggagtggttctagactcaggggacggggtcactcatgctgtgcccatctatgagggctttgccatgcctcactccatcatgcgggtggacattgccggccgcgacgtctcccgctacctccgactcctgctgcgcaaggaaggggttgacttccatacctcggctgagtttgaggttgtccggacaatcaaagagcgagcgtgctacctgtccatcaacccacagaaggatgaggctctggagacggagaaggtgcagtacacgttgccagacggcagcacgcttgatgtggggcctgcacgattccgggcccccgagctgctgttccagccggaccttgtgggggatgagagtgaggggctccatgaggtggtggccttcgccatacacaagtccgacatggacctgcgccggacgctgttcgccagggcagaggacgcacggtggctagagccgctgcactatccttttcagagcacttcatccacttgctcctccctctaccctcggcaccctgggtgggaaagggttgatgctcatcatttattgaggggaagccacttaataaggagtcagacctaaaagggggtgggggacattttcttacctcacccaagaaagaggtcgtcacttttgctgtggccagggccccacctccctctctcagatatgtacaataatttaacacggttgcctgaaaaaaacttttgtaaatcattatagtaataattatggacaaggcccagtgtgtggctctgttttcttgtggctctctgt

SEQ ID NO: 301683 - DNA, 524 bp, Homo sapiens
ctcgcgtaggctgcaggctcggggagggagggcagcggcgccgcgtcgggagccgccgccgtcccggtcctcccgcccgcccgcccatccggtgcctcctgcagcccgcctgctgggcagggccggcgcggcccggccatggagtcctacgacatcatcgccaaccagcctgtggtcatcgacaacggttcgggggtgattaaagctggctttgcaggagaccagattcccaaatactgtttcccaaactatgtcgggcggccgaagcacatgcgggtgatggctggagccctggagggggacctcttcatcggaccaaaagcagaggagcaccgggggctgctgaccatccgctaccccatggagcacggcgtggtgcgagactggaacgacatggaacgcatctggcagtacgtctactccaaggatcagctgcagaccttctcggaggagcatcctgtgctcctcacggaggcccccgctcaacccacagaactaatcatattttacatcttcttctggaa

SEQ ID NO: 301684 - DNA, 109 bp, Homo sapiens
gagactggaacgacatggaacgcatctggcagtacgtctactccaaggatcagctgcagaccttctcggaggaggtgtggcggctgcccctcctgcatgctctgcattc

SEQ ID NO: 301685 - DNA, 524 bp, Homo sapiens
cttgtattactttctagtctgtgctctctctccttggccccaaaggactctcccccatatcatccttcatttcatttgtaaaacgctggaaattttgctctactcccctttttgctaggtatacatttacaatgcctttcacactaggctataaacattacaaactaccagtaggtgccactgtccaacaaataatgctactgcatctcctggagagttagacgtttccagtttggaggacagacatgtgatcccccaaaaacaaccaagtaagctagatatggaacagataaaggctaacatcttgaagcttttaataaggtcttgttaaatgttatagcctggattcatctctgctataggggggcttgttggtttatcttcatatgatttttatgaatataaagaatatgaagataaaccaacaagcccccctatagcagagatgaatccaggctataacatttaacatgaccttattaaaagcttcaagatgttagcctttatctgttccatatctagct

SEQ ID NO: 301686 - DNA, 351 bp, Homo sapiens
acagtagtttagaggtaatcacaattttgtttgtagaaagatgtgtagaaattaatctgtcttgacgatgtttattatattctttagggtgatccaggtcctcaaggtatctcagggaaagatggaccagcaggattacgtggtttcccaggggaaagaggtcttcctggagctcagctggaaaatcgggtcactcccaccggaatactgcacttttccgaccggcttaaaaaacggcgcaccacgagattatatccggcacctggctcagagggtcctacgcccacggagtctcgctgattgctagcacagcagtctgagatcaaactgcaaggtggcagcgaggctggg

SEQ ID NO: 301687 - DNA, 219 bp, Homo sapiens
ggaacaagcaaatacacatgttaattccatgtgaatatttgcagtttattggagaaagtgctttgaaagcaatatctctttgtacatagcaatgtacaaatatatttctttcaatgatactgaaagcctactttccaggtgtttagagttgcttgagtagtaacaaaatcgcatcccatcacacgctatcaaattgtaatttaaatgcttaccttgctt

SEQ ID NO: 301688 - DNA, 7275 bp, Homo sapiens
ctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttaccagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtgacaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtcccatggggccacctggtcctccaggcccaagaggccctcaaggtcccaatggagctgatggaccacaaggacccccaggttctgttggttcagttggtggtgttggagaaaagggtgaacctggagaagcagggaacccagggcctcctggggaagcaggtgtaggcggtcccaaaggagaaagaggagagaaaggggaagctggtccacctggagctgctggacctccaggtgccaaggggccgccaggtgatgatggccctaagggtaacccgggtcctgttggttttcctggagatcctggtcctcctggggaacttggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggcttaccaggtcctcaaggcccaaagggtaacaaaggctctactggacccgctggccagaaaggtgacagtggtcttccagggcctcctgggcctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacatcgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctacctaattgctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggcta

SEQ ID NO: 301689 - DNA, 2992 bp, Homo sapiens
actggatatataatttggaaatcccttccaaaactagtgtacttaaaaattgacactttattcttaactgaaaagccatataaccatgttctatttctaactttacattcatttaatcaaaattatcaatattatggttacaaattaaaccatagtgttttaaatatataaatttacttagaagccttaaaaataaagcaacattaatcattactattttcaactccgtattttcaaaactaaactaggtctgtgactagttataggattctctaattcatacctactctgtttttgttttggggttttttttttgttattatttagggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggcttaccaggtcctcaaggcccaaagggtaacaaaggctctactggacccgctggccagaaaggtgacagtggtcttccagggcctcctgggcctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacatcgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctacctaattgctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggcta

SEQ ID NO: 301690 - DNA, 2215 bp, Homo sapiens
agaggatccggtatagagtggcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctacctaattgctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggcta

SEQ ID NO: 301691 - DNA, 6605 bp, Homo sapiens
ctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttaccagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtgacaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtcccatggggccacctggtcctccaggcccaagaggccctcaaggtcccaatggagctgatggaccacaaggacccccaggttctgttggttcagttggtggtgttggagaaaagggtgaacctggagaagcagggaacccagggcctcctggggaagcaggtgtaggcggtcccaaaggagaaagaggagagaaaggggaagctggtccacctggagctgctggacctccaggtgccaaggggccgccaggtgatgatggccctaagggtaacccgggtcctgttggttttcctggagatcctggtcctcctggggaacttggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggcttaccaggtcctcaaggcccaaagggtaacaaaggctctactggacccgctggccagaaaggtgacagtggtcttccagggcctcctgggcctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacatcgagcatatgaaatttccaatgggtactcagaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctacctaattgctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggcta

SEQ ID NO: 301692 - DNA, 1540 bp, Homo sapiens
gctcatagctgttcctagagtaacccgaggtagtgcactcagcactaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctacctaattgctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggcta

SEQ ID NO: 301693 - DNA, 1593 bp, Homo sapiens
ctttttatttctgctttattttacagtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggcatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctacctaattgctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggcta

SEQ ID NO: 301694 - DNA, 1313 bp, Homo sapiens
ctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgaggtgaggagcacaagaccagagaaggtcttcgtatttcagtgatatggacatagcagtgcagtttttgaacttatacttatttattccattttaattaagctatgctttgtattttaattgtgttgtaatatttccaggaaaaagtgacttgaatatatttggtacttgttttcttgctgtttaagcatttgattacataaatttattagcaataaaaaaaaaaca

SEQ ID NO: 301695 - DNA, 2591 bp, Homo sapiens
ctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaagtctccttttctttctcattattttacaaaaaagtaattaagtttgcttgtgacaaaagatttgtaggaagacatgatgaaaggaaagttgtgaagttgtcattgccattatatctcatatatgaatagcaaatgatgttcttgttaataactcaatgtctggatcaaaacaagaataaatctataattaaacac

SEQ ID NO: 301696 - DNA, 306 bp, Homo sapiens
aaaggtcgagcaggcccaactggagacccaggtccttcaggtcaagcaggagaaaaggttggtaaatgactttaaattcactggtactcttgcagctgatgtttcattatcatttaaatttctttcaataactggtgtcagaaattgagttcttactacattaaagataaaatgtttcattatcattttaaatttgcaaccattacatttacgtttcagtgtaatattaggcaacattaaaatttgcctccagaaagtatttagtgacaccttaaattttctataatgtactgtgaagttaaattt

SEQ ID NO: 301697 - DNA, 728 bp, Homo sapiens
attaagcaaagctttaactccataccttttttattgttcaaatcttaaactgtgaagtaaatatgaaattgactaacatgttttttccaatggaacaagcaaatacacatgttaattccatgtgaatatttgcagtttattggagaaagtgctttgaaagcaatatctctttgtacatagcaatgtacaaatatatttctttcaatgatactgaaagcctactttccaggtgtttagagttgcttgagtagtaacaaaatcgcatcccatcacacgctatcaaattgtaatttaaatgcttaccttgctttactaacaataaacttcatgttcctcaattccttgcaatttaaattaatagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcgtaagttgatactatgcactgtgtcattgtatgtcttatttatgggatatttttatgtccatgtccatcttaatgtcttttcaggtttaaaatgcaggttgaatttttatgt

SEQ ID NO: 301698 - DNA, 576 bp, Homo sapiens
taatttaagtcagtaatgttcttaaaaagatatttttattcagccctagagtaaataaattttaaaatatttaagttagaaaccataaaaattacagttgagtattatttaaacaaacatgtactaaattcccatcacctgtaaatcatattctgagggataaaggaatatacacattaacacatatagattgaaaacaaaaacctcattgatattgtagcaacataggaaaaatcctgattattttgcacaagttattttttagattcaccatggaaaaatgtttaagccattcataaatatttttgcattctctaaattttacagtgtatgctgttatgaaaatattgaaaagttatgaaaacatgaaaatgaaatagctgagaaaatccctttaaattggctgattctctctctagggaattcctggtcctgctggtcccttaggtccacctggtcctccaggcttaccagtaagtacaagacaaaataaccttataaggtagggttaagttacaaatataacagagacacaaatgctccagatttttatctgtgcttttgcatttgcatttt

SEQ ID NO: 301699 - DNA, 429 bp, Homo sapiens
gcccctatgacccctttaaggcgcggccagagtcctcccgcagaaaaacgacttaaaggagacgcgtggcgcgatggcggcggccccacgcgcgggccggcggcgcgggcagccgctcctggcgctgctgcttctgctgctggcgccactgccgccgggggccccgccgggcgccgacgcctacttccccgaggagcgctggagcccggagtcgcccctgcaggcgccgcgcgtgctcatcgcgctgttggcgcgaaacgcggcccacgcgttgcccaccacgctgggcgcactcgagcggctgcggcacccgcgggagcgcacggcgctatgacggaatcttgctctgtcgcccaggctggattgcagtgagccgagatcgcgccactgcactccagcctgggcaacagagcgagactctgtctcaaa

SEQ ID NO: 301700 - DNA, 3675 bp, Homo sapiens
gcccctatgacccctttaaggcgcggccagagtcctcccgcagaaaaacgacttaaaggagacgcgtggcgcgatggcggcggccccacgcgcgggccggcggcgcgggcagccgctcctggcgctgctgcttctgctgctggcgccactgccgccgggggccccgccgggcgccgacgcctacttccccgaggagcgctggagcccggagtcgcccctgcaggcgccgcgcgtgctcatcgcgctgttggcgcgaaacgcggcccacgcgttgcccaccacgctgggcgcactcgagcggctgcggcacccgcgggagcgcacggcgctatgggtggctacggaccacaacatggataacacgtcaactgtgctgcgggagtggctggtggccgtgaagagtttgtaccattccgtggagtggcggccagcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaagcgcacacctgcctacatccctatccgcaagcgagaccgccggggctgctttgcagttcccatggtgcactcgaccttcctgatcgacctgcggaaggcggcgtccaggaacctggccttctacccacctcaccctgactacacctggtcctttgacgacatcatcgtctttgccttctcctgcaagcaggcagaggttcagatgtatgtgtgcaacaaggaggagtacggattcttgccagtgccattgcgcgcccacagcaccctccaggatgaggccgagagcttcatgcatgtgcagctggaggtcatggtgaagcacccgcccgcagagccctcccgcttcatctcggctcccaccaagacaccggacaagatgggcttcgacgaggtcttcatgatcaacctgaggcggcggcaggaccggcgggagcgcatgctgcgggcgctgcaggcacaggagatcgagtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatctatgtgggccggaagcggatgcaggtggagcaccccgagaaggctgtgcctcgcgtgaggaacctggtggaggccgactattcctactggaccctggcctacgtgatctccctgcaaggcgcccgcaaactgctggctgctgagccgctctccaagatgctgcctgtggacgagttcctgcccgtcatgttcgacaaacacccagtgtccgagtacaaggcccacttctccctccgcaacctgcatgccttctctgtggagccgctgctcatctaccccacacactacacaggagacgatggctatgtgagtgacaccgagacctcagtcgtatggaacaatgagcacgtcaagaccgactgggaccgcgccaagtcccagaagatgcgggagcagcaggcactgagccgtgaggccaagaactcggacgtgctccagtccccactggacagtgctgcccgggatgaactctgaggggtagcagccagaaagccaaagcagccatcggtggcccaggctccacgtgcttactgaggacatcagggccacctctggaccccttggcaggccacagagggctctcgtgtggggtggtgtccagccagctcttgctaagcaatcacgtgcacacaggcagcattaatggagtgcctactgcatgccagcaacagggcttggccctggggaattgggaggaaccaagccctcttcatctgttcatgtgcccagcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgccattccaggctctgggattttttttttttttttttttttaagagtagagtctgtctctgtcacccaggctggagtgcagtggtgtgacggctcactgcagcctgcgcctcccagcgtccagcaattcttgtttctcggcctcccaagtagctgggactataggtgcgtgccatcacatctggctagtttttgtatttttagtagagacggggtttcaccatgttggccagactggtctcgaactcctgacctcaagtgatctgcccgccttggccacccaaagtgctagggttacaggcatgagccactgtgcccagcccaggctctgggaatattgagataaataagatgcttctatccatttattcaagcacatattggtcacctactgtgtgcctggcactcatgtcacaaagataagttcctgattcggtacacttactgagcacctgctgtgtgcagggagctgagctatgggatgggaatgggagtaaacaaggtactttttacttttttctttttttcctcactgctagacggtgtgggaacttctcactcattggcttctttcccacacacctgaagagcactgactgtgtgccgggcactagtgatacaaaagagtgtgacagttgttcagtctgcattttcgatcatgggctacatgccgagtgctggggcacagagatgaacaagatcggttccttcacttcttcatgccacaagtgtttattgagcacctgtgtgccaggcctcacagactcccagttgggttgaagaatggttgactgagtttgattcttcctgtaccctcggtcgtctgagctgtgtgcagacaacatccccccaccacccaagagggagggtagctcttccgccaccaggggcaagcacaggtcctggtggccccacgccacatgttagcccccctggagggggcgccagttggagacgggggctgggtgtccctggcccactcccggtcccctgtgctttacctccttgcccttgtgtctcaggtgtggtccctgcctgcttgatgaagttgctctgttcaagcctttggtgggatcatgtgtttgggggcttttaggggacccagctgcactggggcactgcccgtggcctgggtaggacatttcccagcaagggctggaggagttgccgtgccttcagcctgaatcgaatgtcagaaccagccagcggtgcttcaccctcttggggataacttgcttagttttttaataaatgttcctggttggttttcacagcaaaaaaatttgtg

SEQ ID NO: 301701 - DNA, 3256 bp, Homo sapiens
cgtgggttcttgcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaagcgcacacctgcctacatccctatccgcaagcgagaccgccggggctgctttgcagttcccatggtgcactcgaccttcctgatcgacctgcggaaggcggcgtccaggaacctggccttctacccacctcaccctgactacacctggtcctttgacgacatcatcgtctttgccttctcctgcaagcaggcagaggttcagatgtatgtgtgcaacaaggaggagtacggattcttgccagtgccattgcgcgcccacagcaccctccaggatgaggccgagagcttcatgcatgtgcagctggaggtcatggtgaagcacccgcccgcagagccctcccgcttcatctcggctcccaccaagacaccggacaagatgggcttcgacgaggtcttcatgatcaacctgaggcggcggcaggaccggcgggagcgcatgctgcgggcgctgcaggcacaggagatcgagtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatctatgtgggccggaagcggatgcaggtggagcaccccgagaaggctgtgcctcgcgtgaggaacctggtggaggccgactattcctactggaccctggcctacgtgatctccctgcaaggcgcccgcaaactgctggctgctgagccgctctccaagatgctgcctgtggacgagttcctgcccgtcatgttcgacaaacacccagtgtccgagtacaaggcccacttctccctccgcaacctgcatgccttctctgtggagccgctgctcatctaccccacacactacacaggagacgatggctatgtgagtgacaccgagacctcagtcgtatggaacaatgagcacgtcaagaccgactgggaccgcgccaagtcccagaagatgcgggagcagcaggcactgagccgtgaggccaagaactcggacgtgctccagtccccactggacagtgctgcccgggatgaactctgaggggtagcagccagaaagccaaagcagccatcggtggcccaggctccacgtgcttactgaggacatcagggccacctctggaccccttggcaggccacagagggctctcgtgtggggtggtgtccagccagctcttgctaagcaatcacgtgcacacaggcagcattaatggagtgcctactgcatgccagcaacagggcttggccctggggaattgggaggaaccaagccctcttcatctgttcatgtgcccagcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgccattccaggctctgggattttttttttttttttttttttaagagtagagtctgtctctgtcacccaggctggagtgcagtggtgtgacggctcactgcagcctgcgcctcccagcgtccagcaattcttgtttctcggcctcccaagtagctgggactataggtgcgtgccatcacatctggctagtttttgtatttttagtagagacggggtttcaccatgttggccagactggtctcgaactcctgacctcaagtgatctgcccgccttggccacccaaagtgctagggttacaggcatgagccactgtgcccagcccaggctctgggaatattgagataaataagatgcttctatccatttattcaagcacatattggtcacctactgtgtgcctggcactcatgtcacaaagataagttcctgattcggtacacttactgagcacctgctgtgtgcagggagctgagctatgggatgggaatgggagtaaacaaggtactttttacttttttctttttttcctcactgctagacggtgtgggaacttctcactcattggcttctttcccacacacctgaagagcactgactgtgtgccgggcactagtgatacaaaagagtgtgacagttgttcagtctgcattttcgatcatgggctacatgccgagtgctggggcacagagatgaacaagatcggttccttcacttcttcatgccacaagtgtttattgagcacctgtgtgccaggcctcacagactcccagttgggttgaagaatggttgactgagtttgattcttcctgtaccctcggtcgtctgagctgtgtgcagacaacatccccccaccacccaagagggagggtagctcttccgccaccaggggcaagcacaggtcctggtggccccacgccacatgttagcccccctggagggggcgccagttggagacgggggctgggtgtccctggcccactcccggtcccctgtgctttacctccttgcccttgtgtctcaggtgtggtccctgcctgcttgatgaagttgctctgttcaagcctttggtgggatcatgtgtttgggggcttttaggggacccagctgcactggggcactgcccgtggcctgggtaggacatttcccagcaagggctggaggagttgccgtgccttcagcctgaatcgaatgtcagaaccagccagcggtgcttcaccctcttggggataacttgcttagttttttaataaatgttcctggttggttttcacagcaaaaaaatttgtg

SEQ ID NO: 301702 - DNA, 3646 bp, Homo sapiens
gcccctatgacccctttaaggcgcggccagagtcctcccgcagaaaaacgacttaaaggagacgcgtggcgcgatggcggcggccccacgcgcgggccggcggcgcgggcagccgctcctggcgctgctgcttctgctgctggcgccactgccgccgggggccccgccgggcgccgacgcctacttccccgaggagcgctggagcccggagtcgcccctgcaggcgccgcgcgtgctcatcgcgctgttggcgcgaaacgcggcccacgcgttgcccaccacgctgggcgcactcgagcggctgcggcacccgcgggagcgcacggcgctatgggtggctacggaccacaacatggataacacgtcaactgtgctgcgggagtggctggtggccgtgaagagtttgtaccattccgtggagtggcggccagcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaagcgcacacctgcctacatccctatccgcaagcgagaccgccggggctgctttgcagttcccatggtgcactcgaccttcctgatcgacctgcggaaggcggcgtccaggaacctggccttctacccacctcaccctgactacacctggtcctttgacgacatcatcgtctttgccttctcctgcaagcaggcagaggttcagatgtatgtgtgcaacaaggaggagtacggattcttgccagtgccattgcgcgcccacagcaccctccaggatgaggccgagagcttcatgcatgtgcagctggaggtcatggtgaagcacccgcccgcagagccctcccgcttcatctcggctcccaccaagacaccggacaagatgggcttcgacgaggtcttcatgatcaacctgaggcggcggcaggaccggcgggagcgcatgctgcgggcgctgcaggcacaggagatcgagtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatctatgtgggccggaagcggatgcaggtggagcaccccgagaaggctgtgcctcgcgtgaggaacctggtggaggccgactattcctactggaccctggcctacgtgatctccctgcaaggcgcccgcaaactgctggctgctgagccgctctccaagatgctgcctgtggacgagttcctgcccgtcatgttcgacaaacacccagtgtccgagtacaaggcccacttctccctccgcaacctgcatgccttctctgtggagccgctgctcatctaccccacacactacacaggagacgatggctatgtgagtgacaccgagacctcagtcgtatggaacaatgagcacgtcaagaccgactgggaccgcgccaagtcccagaagatgcgggagcagcaggcactgagccgtgaggccaagaactcggacgtgctccagtccccactggacagtgctgcccgggatgaactctgaggggtagcagccagaaagccaaagcagccatcggtggcccaggctccacgtgcttactgaggacatcagggccacctctggaccccttggcaggccacagagggctctcgtgtggggtggtgtccagccagctcttgctaagcaatcacgtgcacacaggcagcattaatggagtgcctactgcatgccagcaacagggcttggccctggggaattgggaggaaccaagccctcttcatctgttcatgtgcccagcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgccattccaggctctgggattttttttttttttttttttttaagagtagagtctgtctctgtcacccaggctggagtgcagtggtgtgacggctcactgcagcctgcgcctcccagcgtccagcaattcttgtttctcggcctcccaagtagctgggactataggtgcgtgccatcacatctggctagtttttgtatttttagtagagacggggtttcaccatgttggccagactggtctcgaactcctgacctcaagtgatctgcccgccttggccacccaaagtgctagggttacaggcatgagccactgtgcccagcccaggctctgggaatattgagataaataagatgcttctatccatttattcaagcacatattggtcacctactgtgtgcctggcactcatgtcacaaagataagttcctgattcggtacacttactgagcacctgctgtgtgcagggagctgagctatgggatgggaatgggagtattcctcactgctagacggtgtgggaacttctcactcattggcttctttcccacacacctgaagagcactgactgtgtgccgggcactagtgatacaaaagagtgtgacagttgttcagtctgcattttcgatcatgggctacatgccgagtgctggggcacagagatgaacaagatcggttccttcacttcttcatgccacaagtgtttattgagcacctgtgtgccaggcctcacagactcccagttgggttgaagaatggttgactgagtttgattcttcctgtaccctcggtcgtctgagctgtgtgcagacaacatccccccaccacccaagagggagggtagctcttccgccaccaggggcaagcacaggtcctggtggccccacgccacatgttagcccccctggagggggcgccagttggagacgggggctgggtgtccctggcccactcccggtcccctgtgctttacctccttgcccttgtgtctcaggtgtggtccctgcctgcttgatgaagttgctctgttcaagcctttggtgggatcatgtgtttgggggcttttaggggacccagctgcactggggcactgcccgtggcctgggtaggacatttcccagcaagggctggaggagttgccgtgccttcagcctgaatcgaatgtcagaaccagccagcggtgcttcaccctcttggggataacttgcttagttttttaataaatgttcctggttggttttcacagcaaaaaaatttgtg

SEQ ID NO: 301703 - DNA, 2301 bp, Homo sapiens
caggacctgacggggtaactagatccctggctttctgggcaagctccctccggagggcgggaggagagtgacaggcccgatcttgcaccccagctatgtgggccggaagcggatgcaggtggagcaccccgagaaggctgtgcctcgcgtgaggaacctggtggaggccgactattcctactggaccctggcctacgtgatctccctgcaaggcgcccgcaaactgctggctgctgagccgctctccaagatgctgcctgtggacgagttcctgcccgtcatgttcgacaaacacccagtgtccgagtacaaggcccacttctccctccgcaacctgcatgccttctctgtggagccgctgctcatctaccccacacactacacaggagacgatggctatgtgagtgacaccgagacctcagtcgtatggaacaatgagcacgtcaagaccgactgggaccgcgccaagtcccagaagatgcgggagcagcaggcactgagccgtgaggccaagaactcggacgtgctccagtccccactggacagtgctgcccgggatgaactctgaggggtagcagccagaaagccaaagcagccatcggtggcccaggctccacgtgcttactgaggacatcagggccacctctggaccccttggcaggccacagagggctctcgtgtggggtggtgtccagccagctcttgctaagcaatcacgtgcacacaggcagcattaatggagtgcctactgcatgccagcaacagggcttggccctggggaattgggaggaaccaagccctcttcatctgttcatgtgcccagcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgccattccaggctctgggattttttttttttttttttttttaagagtagagtctgtctctgtcacccaggctggagtgcagtggtgtgacggctcactgcagcctgcgcctcccagcgtccagcaattcttgtttctcggcctcccaagtagctgggactataggtgcgtgccatcacatctggctagtttttgtatttttagtagagacggggtttcaccatgttggccagactggtctcgaactcctgacctcaagtgatctgcccgccttggccacccaaagtgctagggttacaggcatgagccactgtgcccagcccaggctctgggaatattgagataaataagatgcttctatccatttattcaagcacatattggtcacctactgtgtgcctggcactcatgtcacaaagataagttcctgattcggtacacttactgagcacctgctgtgtgcagggagctgagctatgggatgggaatgggagtaaacaaggtactttttacttttttctttttttcctcactgctagacggtgtgggaacttctcactcattggcttctttcccacacacctgaagagcactgactgtgtgccgggcactagtgatacaaaagagtgtgacagttgttcagtctgcattttcgatcatgggctacatgccgagtgctggggcacagagatgaacaagatcggttccttcacttcttcatgccacaagtgtttattgagcacctgtgtgccaggcctcacagactcccagttgggttgaagaatggttgactgagtttgattcttcctgtaccctcggtcgtctgagctgtgtgcagacaacatccccccaccacccaagagggagggtagctcttccgccaccaggggcaagcacaggtcctggtggccccacgccacatgttagcccccctggagggggcgccagttggagacgggggctgggtgtccctggcccactcccggtcccctgtgctttacctccttgcccttgtgtctcaggtgtggtccctgcctgcttgatgaagttgctctgttcaagcctttggtgggatcatgtgtttgggggcttttaggggacccagctgcactggggcactgcccgtggcctgggtaggacatttcccagcaagggctggaggagttgccgtgccttcagcctgaatcgaatgtcagaaccagccagcggtgcttcaccctcttggggataacttgcttagttttttaataaatgttcctggttggttttcacagcaaaaaaatttgtg

SEQ ID NO: 301704 - DNA, 2159 bp, Homo sapiens
ctatgggcccattaacgcttgaatttccttaccccttagacatatgggccggaccccgggcaaaaaaactttgccctagaggcctaggcatggcagccgctctccaagatgctgcctgtggacgagttcctgcccgtcatgttcgacaaacacccagtgtccgagtacaaggcccacttctccctccgcaacctgcatgccttctctgtggagccgctgctcatctaccccacacactacacaggagacgatggctatgtgagtgacaccgagacctcagtcgtatggaacaatgagcacgtcaagaccgactgggaccgcgccaagtcccagaagatgcgggagcagcaggcactgagccgtgaggccaagaactcggacgtgctccagtccccactggacagtgctgcccgggatgaactctgaggggtagcagccagaaagccaaagcagccatcggtggcccaggctccacgtgcttactgaggacatcagggccacctctggaccccttggcaggccacagagggctctcgtgtggggtggtgtccagccagctcttgctaagcaatcacgtgcacacaggcagcattaatggagtgcctactgcatgccagcaacagggcttggccctggggaattgggaggaaccaagccctcttcatctgttcatgtgcccagcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgccattccaggctctgggattttttttttttttttttttttaagagtagagtctgtctctgtcacccaggctggagtgcagtggtgtgacggctcactgcagcctgcgcctcccagcgtccagcaattcttgtttctcggcctcccaagtagctgggactataggtgcgtgccatcacatctggctagtttttgtatttttagtagagacggggtttcaccatgttggccagactggtctcgaactcctgacctcaagtgatctgcccgccttggccacccaaagtgctagggttacaggcatgagccactgtgcccagcccaggctctgggaatattgagataaataagatgcttctatccatttattcaagcacatattggtcacctactgtgtgcctggcactcatgtcacaaagataagttcctgattcggtacacttactgagcacctgctgtgtgcagggagctgagctatgggatgggaatgggagtaaacaaggtactttttacttttttctttttttcctcactgctagacggtgtgggaacttctcactcattggcttctttcccacacacctgaagagcactgactgtgtgccgggcactagtgatacaaaagagtgtgacagttgttcagtctgcattttcgatcatgggctacatgccgagtgctggggcacagagatgaacaagatcggttccttcacttcttcatgccacaagtgtttattgagcacctgtgtgccaggcctcacagactcccagttgggttgaagaatggttgactgagtttgattcttcctgtaccctcggtcgtctgagctgtgtgcagacaacatccccccaccacccaagagggagggtagctcttccgccaccaggggcaagcacaggtcctggtggccccacgccacatgttagcccccctggagggggcgccagttggagacgggggctgggtgtccctggcccactcccggtcccctgtgctttacctccttgcccttgtgtctcaggtgtggtccctgcctgcttgatgaagttgctctgttcaagcctttggtgggatcatgtgtttgggggcttttaggggacccagctgcactggggcactgcccgtggcctgggtaggacatttcccagcaagggctggaggagttgccgtgccttcagcctgaatcgaatgtcagaaccagccagcggtgcttcaccctcttggggataacttgcttagttttttaataaatgttcctggttggttttcacagcaaaaaaatttgtg

SEQ ID NO: 301705 - DNA, 3198 bp, Homo sapiens
gcccctatgacccctttaaggcgcggccagagtcctcccgcagaaaaacgacttaaaggagacgcgtggcgcgatggcggcggccccacgcgcgggccggcggcgcgggcagccgctcctggcgctgctgcttctgctgctggcgccactgccgccgggggccccgccgggcgccgacgcctacttccccgaggagcgctggagcccggagtcgcccctgcaggcgccgcgcgtgctcatcgcgctgttggcgcgaaacgcggcccacgcgttgcccaccacgctgggcgcactcgagcggctgcggcacccgcgggagcgcacggcgctatgggtggctacggaccacaacatggataacacgtcaactgtgctgcgggagtggctggtggccgtgaagagtttgtaccattccgtggagtggcggccagcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaagcgcacacctgcctacatccctatccgcaagcgagaccgccggggctgctttgcagttcccatggtgcactcgaccttcctgatcgacctgcggaaggcggcgtccaggaacctggccttctacccacctcaccctgactacacctggtcctttgacgacatcatcgtctttgccttctcctgcaagcaggcagtgaagcacccgcccgcagagccctcccgcttcatctcggctcccaccaagacaccggacaagatgggcttcgacgaggtcttcatgatcaacctgaggcggcggcaggaccggcgggagcgcatgctgcgggcgctgcaggcacaggagatcgagtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatctatgtgggccggaagcggatgcaggtggagcaccccgagaaggctgtgcctcgcgtgaggaacctggtggaggccgactattcctactggaccagtgctgcccgggatgaactctgaggggtagcagccagaaagccaaagcagccatcggtggcccaggctccacgtgcttactgaggacatcagggccacctctggaccccttggcaggccacagagggctctcgtgtggggtggtgtccagccagctcttgctaagcaatcacgtgcacacaggcagcattaatggagtgcctactgcatgccagcaacagggcttggccctggggaattgggaggaaccaagccctcttcatctgttcatgtgcccagcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgccattccaggctctgggattttttttttttttttttttttaagagtagagtctgtctctgtcacccaggctggagtgcagtggtgtgacggctcactgcagcctgcgcctcccagcgtccagcaattcttgtttctcggcctcccaagtagctgggactataggtgcgtgccatcacatctggctagtttttgtatttttagtagagacggggtttcaccatgttggccagactggtctcgaactcctgacctcaagtgatctgcccgccttggccacccaaagtgctagggttacaggcatgagccactgtgcccagcccaggctctgggaatattgagataaataagatgcttctatccatttattcaagcacatattggtcacctactgtgtgcctggcactcatgtcacaaagataagttcctgattcggtacacttactgagcacctgctgtgtgcagggagctgagctatgggatgggaatgggagtaaacaaggtactttttacttttttctttttttcctcactgctagacggtgtgggaacttctcactcattggcttctttcccacacacctgaagagcactgactgtgtgccgggcactagtgatacaaaagagtgtgacagttgttcagtctgcattttcgatcatgggctacatgccgagtgctggggcacagagatgaacaagatcggttccttcacttcttcatgccacaagtgtttattgagcacctgtgtgccaggcctcacagactcccagttgggttgaagaatggttgactgagtttgattcttcctgtaccctcggtcgtctgagctgtgtgcagacaacatccccccaccacccaagagggagggtagctcttccgccaccaggggcaagcacaggtcctggtggccccacgccacatgttagcccccctggagggggcgccagttggagacgggggctgggtgtccctggcccactcccggtcccctgtgctttacctccttgcccttgtgtctcaggtgtggtccctgcctgcttgatgaagttgctctgttcaagcctttggtgggatcatgtgtttgggggcttttaggggacccagctgcactggggcactgcccgtggcctgggtaggacatttcccagcaagggctggaggagttgccgtgccttcagcctgaatcgaatgtcagaaccagccagcggtgcttcaccctcttggggataacttgcttagttttttaataaatgttcctggttggttttcacagcaaaaaaatttgtg

SEQ ID NO: 301706 - DNA, 2537 bp, Homo sapiens
  misc_feature (2414)..(2414): n is a, c, g, or t
  misc_feature (2417)..(2417): n is a, c, g, or t
gcccctatgacccctttaaggcgcggccagagtcctcccgcagaaaaacgacttaaaggagacgcgtggcgcgatggcggcggccccacgcgcgggccggcggcgcgggcagccgctcctggcgctgctgcttctgctgctggcgccactgccgccgggggccccgccgggcgccgacgcctacttccccgaggagcgctggagcccggagtcgcccctgcaggcgccgcgcgtgctcatcgcgctgttggcgcgaaacgcggcccacgcgttgcccaccacgctgggcgcactcgagcggctgcggcacccgcgggagcgcacggcgctatgggtggctacggaccacaacatggataacacgtcaactgtgctgcgggagtggctggtggccgtgaagagtttgtaccattccgtggagtggcggccagcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaagcgcacacctgcctacatccctatccgcaagcgagaccgccggggctgctttgcagttcccatggtgcactcgaccttcctgatcgacctgcggaaggcggcgtccaggaacctggccttctacccacctcaccctgactacacctggtcctttgacgacatcatcgtctttgccttctcctgcaagcaggcagaggttcagatgtatgtgtgcaacaaggaggagtacggattcttgccagtgccattgcgcgcccacagcaccctccaggatgaggccgagagcttcatgcatgtgcagctggaggtcatggtgaagcacccgcccgcagagccctcccgcttcatctcggctcccaccaagacaccggacaagatgggcttcgacgaggtcttcatgatcaacctgaggcggcggcaggaccggcgggagcgcatgctgcgggcgctgcaggcacaggagatcgagtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatctatgtgggccggaagcggatgcaggtggagcaccccgagaaggctgtgcctcgcgtgaggaacctggtggaggccgactattcctactggaccctggcctacgtgatctccctgcaaggcgcccgcaaactgctggctgctgagccgctctccaagatgctgcctgtggacgagttcctgcccgtcatgttcgacaaacacccagtgtccgagtacaaggcccacttctccctccgcaacctgcatgccttctctgtggagccgctgctcatctaccccacacactacacaggagacgatggctatgtgagtgacaccgagacctcagtcgtatggaacaatgagcacgtcaagaccgactgggaccgcgccaagtcccagaagatgcgggagcagcaggcactgagccgtgaggccaagaactcggacgtgctccagtccccactggacagtgctgcccgggatgaactctgaggggtagcagccagaaagccaaagcagccatcggtggcccaggctccacgtgcttactgaggacatcagggccacctctggaccccttggcaggccacagagggctctcgtgtggggtggtgtccagccagctcttgctaagcaatcacgtgcacacaggcagcattaatggagtgcctactgcatgccagcaacagggcttggccctggggaattgggaggaaccaagccctcttcatctgttcatgtgcccagcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgccattccaggctctgggattttaanaanttaatataaggaagtacaacagtctggcttgggcacccagggttgtgtactgacagtggtgtataagagtcagtggaagctgggctcccaagggtcaagaatcctgttacgggcctccca

SEQ ID NO: 301707 - DNA, 1548 bp, Homo sapiens
  misc_feature (1470)..(1470): n is a, c, g, or t
  misc_feature (1479)..(1479): n is a, c, g, or t
  misc_feature (1527)..(1527): n is a, c, g, or t
  misc_feature (1544)..(1544): n is a, c, g, or t
gcccctatgacccctttaaggcgcggccagagtcctcccgcagaaaaacgacttaaaggagacgcgtggcgcgatggcggcggccccacgcgcgggccggcggcgcgggcagccgctcctggcgctgctgcttctgctgctggcgccactgccgccgggggccccgccgggcgccgacgcctacttccccgaggagcgctggagcccggagtcgcccctgcaggcgccgcgcgtgctcatcgcgctgttggcgcgaaacgcggcccacgcgttgcccaccacgctgggcgcactcgagcggctgcggcacccgcgggagcgcacggcgctatgggtggctacggaccacaacatggataacacgtcaactgtgctgcgggagtggctggtggccgtgaagagtttgtaccattccgtggagtggcggccagcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaagcgcacacctgcctacatccctatccgcaagcgagaccgccggggctgctttgcagttcccatggtgcactcgaccttcctgatcgacctgcggaaggcggcgtccaggaacctggccttctacccacctcaccctgactacacctggtcctttgacgacatcatcgtctttgccttctcctgcaagcaggcagaggttcagatgtatgtgtgcaacaaggaggagtacggattcttgccagtgccattgcgcgcccacagcaccctccaggatgaggccgagagcttcatgcatgtgcagctggaggtcatggtgaagcacccgcccgcagagccctcccgcttcatctcggctcccaccaagacaccggacaagatgggcttcgacgaggtcttcatgatcaacctgaggcggcggcaggaccggcgggagcgcatgctgcgggcgctgcaggcacaggagatcgagtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatcancatgacctncagctgcacatgcatgaagctctcggcctcatcctggagggtgctgtnggcgcgcaatggcactngcaa

SEQ ID NO: 301708 - DNA, 1130 bp, Homo sapiens
gcccctatgacccctttaaggcgcggccagagtcctcccgcagaaaaacgacttaaaggagacgcgtggcgcgatggcggcggccccacgcgcgggccggcggcgcgggcagccgctcctggcgctgctgcttctgctgctggcgccactgccgccgggggccccgccgggcgccgacgcctacttccccgaggagcgctggagcccggagtcgcccctgcaggcgccgcgcgtgctcatcgcgctgttggcgcgaaacgcggcccacgcgttgcccaccacgctgggcgcactcgagcggctgcggcacccgcgggagcgcacggcgctatgggtggctacggaccacaacatggataacacgtcaactgtgctgcgggagtggctggtggccgtgaagagtttgtaccattccgtggagtggcggccagcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaagcgcacacctgcctacatccctatccgcaagcgagaccgccggggctgctttgcagttcccatggtgcactcgaccttcctgatcgacctgcggaaggcggcgtccaggaacctggccttctacccacctcaccctgactacacctggtcctttgacgacatcatcgtctttgccttctcctgcaagcaggcagaggttcagatgtatgtgtgcaacaaggaggagtacggattcttgccagtgccattgcgcgcccacagcaccctccaggatgaggccgagagcttcatgcatgtgcagctggaggtcatggcacccgccccagagccctcccgcttcatcgcgcgtcccgggcgccgcccgggagccgaaggcaaagctcgcttgatcttgattttcagtacgaatacagacggtcacg

SEQ ID NO: 301709 - DNA, 663 bp, Homo sapiens
ggccacagtgggaagggggcaggcaggagcagcatgaaccccctgtgccctcctctccccaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttcc

SEQ ID NO: 301710 - DNA, 1036 bp, Homo sapiens
caagaaaaaaaaaacttaaggctagattaatgagccccctgattatcggccgaggcagactcctgtctctctccggagccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccaccttcacgcggttccaccggggcacccctccactgaagcaccttcccacatcatgctggagcctgtgccccgatccatccttcaacgaccaacaccaacaagcctgcactgagagaaaaggccgcaacacgagcaggagcggaagacgcctggagaagagaccgtgtaaacaaccaaaagcaaaaacgcagaaagaggacaaagaaaataaggaaagagacgatgaggaaaggcaaaacgaacaccccaaatcgaacgaaaggagaagccggccaaaataaaggaggaagaacacacggacgagaaaagaagaagacaagaggaaaaagaagaaggagggagacgacaga

SEQ ID NO: 301711 - DNA, 763 bp, Homo sapiens
  misc_feature (3)..(3): n is a, c, g, or t
  misc_feature (6)..(7): n is a, c, g, or t
  misc_feature (737)..(737): n is a, c, g, or t
  misc_feature (750)..(750): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtctttgtgccaggaagactgcgtgcagaaggtgactgtctcagtggagctgggtcatctcaggtggggagttggggtccccgaaggtgaggaccctctggggaggagggtgcttctctgagacactttcttttcctcacacctgttcctcgccagcagccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcacttctctacttgtgaggatccngcccgatgagccntgggaggctttgt

SEQ ID NO: 301712 - DNA, 306 bp, Homo sapiens
gcggccgcctactactactactgctcgaattcaagcttctaacgatgtacggggagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttcc

SEQ ID NO: 301713 - DNA, 899 bp, Homo sapiens
  misc_feature (3)..(3): n is a, c, g, or t
  misc_feature (6)..(7): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtctttgtgccaggaagactgcgtgcagaaggtgactgtctcagtggagctgggtcatctcaggtggggagttggggtccccgaaggtgaggaccctctggggaggagggtgcttctctgagacactttcttttcctcacacctgttcctcgccagcagccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgggtggatttcccctcaggcaccaggtcacatgtccccgcccccaggcactccaccctgtgtggggctcagggtgagaaggatgaagagggacccacaggctccctcaccccttaccgtgggcaaatgcttgcacctg

SEQ ID NO: 301714 - DNA, 617 bp, Homo sapiens
  misc_feature (3)..(3): n is a, c, g, or t
  misc_feature (6)..(7): n is a, c, g, or t
  misc_feature (580)..(580): n is a, c, g, or t
ggnagnngccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtctttgtgccaggaagactgcgtgcagaaggtgactgtctcagtggagctgggtcatctcaggtggggagttggggtccccgaaggtgaggaccctctggggaggagggtgcttctctgagacactttcttttcctcacacctgttcctcgccagcagccttggctccttgaacttttggccgccatgtgcttcccgaaggtcctctctgatgacatgaagaagctgaaggcccgaatgcaccaggccatagagattntatgattgcacgacttcgagggctacctggagacgtg
